United States Patent 9,771,598 (ISOLATED POLYNUCLEOTIDES AND POLYPEPTIDES, CONSTRUCT AND PLANTS COMPRISING SAME AND METHODS OF USING SAME FOR INCREASING NITROGEN USE EFFICIENCY OF PLANTS) - sequence listing, part 3

SEQ ID NO: 2823 - DNA, 648 bp, Panicum virgatum
cagttagaaaggcagatcaaagcatctccgtgcctccacagcaaagcctagattcgcaattattgagctgcctccactataaaacgggaaccaaccacaaggaatgaacacagcaaacaagcgcacaacaaggacagcacagcaacataaaccctagtaccaagaagagagaagaggctttgcaagttcgcaggagctagctgtttactgcgaatgaacatccagaggaagcctggagactggaactgcaagaactgccagcacctcaacttcagccgccgtgactactgccagcgctgccgtgatccacggccggacttgcagttcagtgacggctatagcactggcggtgtgctgacctccctcgacattcgcccaggtgactggtactgcagctgcggctaccataactttgccagccgcagcagctgcttcaagtgcggcactatcgtcagggacttcccagcggggcaaggtgcagctggtgctgagggtgaccttgctcgtggccgtgacagcgccgcagttcgtgctgggtggaaagctggcgattggatatgcacaaggccaggttgcaacgtgcacaatttcgcaagcaggactgagtgctacaggtgcaatgcaccaagggaaacaggtacaaatgtc

SEQ ID NO: 2824 - DNA, 585 bp, Sorghum bicolor
tgcagggctaggtgttgactgcgaatgaacatccagaggaagcctggagattggaactgcaagaactgccagcacctcaacttcagccgccgtgattactgtcagcgttgccgtgacccacgccctgacttgcagttcagtgacagctatagcacgggtggtgtgctgacctccctggacatccgtccaggtgactggtactgcagctgcggctaccacaactttgccagccgcagcagctgcttcaagtgcggcaccatcgtcagggacttcccagcaggacaaggtgcagccggtgctgaggttgacttcgctcgtggacgcgacagcgccgcagttcgtgctgggtggaaagctggcgactggatctgcatttctgtactttggccaggcctggttgcaacgtgcacaactttgctagcaggatggagtgctataggtgcaatggaccaagggaggcaggtatatgtcgggaagtaagaggcgaccgaggtgataccaagaccgtgagatgtgacgagctggccgagcgatggaaccaactgctgtcacacactcaccatcaggcatccaggaaggatgagt

SEQ ID NO: 2825 - DNA, 1419 bp, Oryza sativa
gtcggcccaaatagcccaactcgtgatcgcgccgccgccgtgctctccaccggagagagcggcggaggagagcaagtggggataggggccggtcggggttgcgacgggcgggagcgggaggaggcgcacgctgcctgaatgccggcgccgtcgacgacctcgccggtgattggttcgcgctccggcgatcgtcgagggccgcccgggcaggcggaggagcggaggaggcaaagcgagtggccgcgagacctccgcttccatcgcgcggctcgcagtcgcaaaccctaccaaatttgctccagctagaaaggctaagatcagaacagagcatctccgcgcctccacagcacaccctggattcgcaattattgggggcaactccactataaaaagcgaaccatccacaagaagtaagaacacaccaagaaagcaagctcacaacaaggacaagacaggaactgaaagccctagtactaagaacagcaaccacctctgaaagctttacaagttcgcaggggcttaactgcgaatgaacatccagaggaagccaggagactggaactgcaaatcgtgccagcatctcaacttcagccgccgggactactgccagcgctgccataccccacgccaggacctgccgcttggcgatggttatgtcccaggtggtgtgctgacctccctggacattcgcccgggcgactggtactgcaactgcggctatcacaactttgctagccgagcaagctgcttcaaatgtggcgccattgtgaaggaccttccagcaggccaaggtggtggtgttgccaacggtgactttgcccgtgccctcgacagcagcgcagttcgtgctgggtggaaggcaggcgactggatttgcacaaggcctggttgcaacgtccacaactttgcaagtaggattgagtgctataggtgcaatgcacctagggaagcaggtaatgtgaagtaagaaaggactgacgcgaccaaagatcgtgagacgtgacgagctggccgaggatgaataaagtgactgctgtcagttgtcacattcacaggctgcgatccagaaactatggatgggactatgtagtaacgtgctgatatattattgctaagtgttactactgcatggttgcaagggtggtagaagtaccttagcttccaagatcgttgtaatgtgtgagtttaattttggcgttttaagtaataagtctagtgattgcaggattgtacggggtaatgtacttgcattatccattataatcttaagcatccaatataattatgcaataattcgtgccttactgctcttagctacagctggttgggtttgaaggctttatttgttattcttacatagtgtatgttactcatgtcattatttagagtctgctatatacaaattatgcattattatta

SEQ ID NO: 2826 - DNA, 1546 bp, Sorghum bicolor
gcgaaaggccgagagctcgagctccccgccccggcaccacatccaacccgaaccttccagaccccgcgcctcccccgccctacgatccacagcgcgggtttttcacgatccggagctccttgcccgagcaaacgacccgacgcgcggcgcgatcgcgacctccgccacagctgcagcgagagctagccaatggacgtgctgaagcgcgagctgcagcgcaagcgccagctcctcaacgccgatttcggcggccgcagggtcctccgccgcgccgagatcgaggcccgcgagctccagcgcatccgcgaggccgagcgccagctcctcctccaaaagcagctcaggcattcccgcctggcagcggtgtcctccccttcctcgagctcctcctcgcccacctccgcacccgccgacgccgacgcgtcgcgggcagagagcgggtccgaggagtcgctcccgagggaggaggtcatccgacgcttgcgcgtgctgcggcagccggccacgctctttggcgaggacgacgtcgcgcgcctccgccgcctccgggacctgatcgaggaccccgccgcgctcgccgacgtcgatgaggcggagatcggggaggggcagaccaacgacttcctccgcgacatccaggcgctgcgtgccaaggctgcggccgcgacgaagcccaaggcggccggcgtggaggcccagcgtggggagggcgacgacggcgtaccgggagatgtgccgttcgaggagctctgcgacgaggacaagatcaccgcgttcttcaggaggctgatgggcgagtggactcaggaggtggacggtatgccggaggcggaacggcggacggcgaaagggaaggccgcggtagccacctgcaagcagtgcgcgcgatacctcgacccgctcttcaagcagtgcaagaagaaggagggcatcatcctgaatgcacaaacacaaccatcgacgatcaggttacaacttgtgccctaagctctccctcctgatatccgacaagcattgctggaggtggtcaagtgctgtatgagacgagactacttgtccgcagtggacaactatatcaagctagcgataggcaactcgccatggccaattggtgtgaccatggttggtattcatgagcgatcggctcgcgaaaagatctacacaaacagcgtggctcacatcatgaatgatgagacgaccagaaagtacctgcaatctgtgaagaggctcattacattctgccagaggaagtaccccactgatccatcaaggtcggtagagttcaacagcctggcaaatggcagtgatctgcagtctctcctggcgcagcaaaacgcgaagaattcagaagaaacgcttcggttagtggctgcgtcatgacaaggttggattagatttgtgctcggaattctgggcaagttcgattcttgtgggatttgtgattcgaattagtacttatttgtaagaacctgaattgcatgtccggccgttctgccttgctggaccgtggaacctaatcaaaactggagcgtactgattctctctt

SEQ ID NO: 2827 - DNA, 1414 bp, Setaria italica
agttcctccccaccccggccgcagctctccgacgatccagccccggccgagatcgaggccctagcctaacgacgcgacgcgcggcgccatcgcgaacttcgccacagcaaccgcaggagctggcaatggatgtcctgaagcgcgagctgcagcggaagcgccagctcctggacgccgacttcggcgcccgcaagatcctccggcgcgccgagatcgaggcccgcgagctccagcgcatccgcgaggccgagcgccggcgcctcctccaaaagcagctccgggattcccacccggcagcctcctcgccgcccggtacctactctggctcctcgcccgcctccgcggcagccgacgcgccaccagcggagaatggtgcgagtggccagacggagtcgctcccgagggacgaggtcatccgacgcctgcgcgtgctgcggcagccggccacgctcttcggcgaggacgatgccgcgcgcctccgccgtctgaacgacgtgctcgaggaccccaccgcgctggccgacgtcgacgcggacgagatcggggaggggcagaccaacgacttcctccgcgacatccaggcgctgcgggtcaaggctgcggcagcgacgaagcccaaggccggcgcggaggcccagcggagggagggcgacggcgaggagagggaggtgccgttcgaggagctctgcgacgaggataagatcgccgcgttcttcaggaggctgatgggcgagtggagccaggagatggacgagatgcccgaggcggagcggcgtacggccaaagggaaggccgcggtggccacctgcaagcagtgcgcgcgatacctcgacccgctattcaagcagtgcaagaagaaggctctccctcctgacgtccgacaggcattgttggaggtggtcaagtgctgcatgagacgagactatttggctgcagtggacaattatatcaagctagcaatcggcaactcgccatggccaattggtgtgaccatggttggtattcatgagcgatcggcccgcgagaagatctacacgaacagcgtggctcacatcatgaatgatgagacaaccagaaagtacctgcagtccgtgaagagactcataacattctgccagaggaagtaccccactgatccatcaaggtcagtggagttcaacagcctggcaaatggaagtgatctgcagtctctcctggcggagcagaacgcgaagaattcagaagaaactcttcaattagtggcagcttcgtgattcttgtgtgattcattcgtgattcgaaaactgcttaattcttatgaacatgaattgcatacctgattgttacaggattgtggaagctactgtaattggaattcaggtttaaatactggtgttggacgttgctgggttcgaccatattaaatttttctctg

SEQ ID NO: 2828 - DNA, 2297 bp, Sorghum bicolor
aaattgagataagtacctatcaacatgcaaatatgatctcaattgaaatacttgaaaggcatgtacttatccaaaaactatttcctgaaccatatatataaatccaggaaccacccccgtgatttcgaaaatccaatctcgagctccctttccctctccactgcggcgccggctgctgctccagtcggctctcgaagcctctgtccgtctgtcgagccatggcgaagggaagggctcaccattcgaagcgacccacccaccaactactcctcgcggctgtcctatccgtctccgttctcctcccgctgttcgtgccggcggcagcaaccgtggcggtggcggagggggacggtgtgtcggcgctcggcggcgggaagccgttggcggtcgggaaggacgaggggaagctggtcgcggagggggatgctggtggaggcgggtcggtggaggaggacgagttcgcgggtggcttcggctccctcgacagcatgctgcagtgggcgatcggaaattctgacccagagaaactgaaagaggaggcggctgatgcgcagaagttatctgaagatgaactgctcaagcggcgtcaggagatcaaggagttgatggagaagttaaagatgccatcagatgctgacttaatgaaaattgcaattgatgacttaaataattcctccatttcactggaggatcgccaacgcgcactgcaggaacttttagttcttgttgagcccattgacaatgctaatgatcttgacaaacttgggggcctccttcctgtgattcaagagcttagtaacgcaaatgaagaaatacggaccacctctgcatgggtccttggtacagccagtcagaacaacgaacttgtacaaaaccagatccttggttacggagctttggcaaggttggtgaagatgggttattccacatctgcagaagaagctgcaaaagcattgtatgctatatcatctttgatcagaaataatgtaaatggtcaagaggcattccattcagaaaatggcagtgcaatgttgcagcacatattggtcagcaacaatattgatgttaggctacagaagaaggtagtgtttttagtaacagatttggcggactttcagctaaattctggaattgtgcagcttcctttcttgagtgaacgtctttttctgaagtcaataatggatatgttatcaaggtttgacctagaccttcaggaaaaggttttattggccattaagaatctattgaaactttcctcaactgatgtggaggattttgagttctgtgatctcagtaatgtactgctcagactaggggtacagttggaggacttgacaccagaggatcaaaaggagttcgctgtggaggttgatgccctccggagagaagttcaaacgctcttccaacagaagctcaagcagggtaaagcgaccgtggcatgatatgcggatgaccaccagaagatttgcccttctaaatggaaatttaatggatcatcttttgtgggatactacagttagatggtgggcttgggttttctccgtgcaattttcaagaaccattcagtcgaaggggtcgggtggatgcacttcggcaaggttgtgtagtatatgatggcatgacaggttaggaagtaaggcacgtgcttatgatgactccattttggcaaactaattatgcttctcacaaagttctgtgatatgggcactgcaacgaagcatttttttttccttgttccgttgcagcggtagcttcgttttgagaatgattggatttgttgatcagatcatttgcgatgaatctaaattgagatctctgtgtaagtgtcttaacaggggagcggaggattggttctgaatccctggctgtatctagtctagcttctgtttgctgtatcacacgtgtgtcatagctagaagtgctggaacaaaacagtccatgacaagcatatgctattactattcgctttgggtcttgtactcttgttgccagtgtcaagaaattgggtacttgacggtgatgttcacacgtgcgacgaatagtgtatgcggaccacgatgttaacacgtgcgacgaatagtatatgcggaatgcacggtgtatacacgttttggaagggaggccatttctcacgcacgtgcgctttcagcgtgtttctgaatctctgtataccgttgtaatagaaacagcctaagtttataaatttttgactagcatttctgccacggggtttttttttttttttttgcaggcgctcattcctggtgcaacgaacaggccctaatgaaacttggacc

SEQ ID NO: 2829 - DNA, 2007 bp, Setaria italica
aaaaataagttcccgaaactataaattcaggaaccaccccccaagatttcgaaaattcgatagccaattccttttccctccccactccgctgttctgctcctctcgaagcatcgatctctctctctctctctatctctctctcgagccatggcgaaggcaagggcacactcgtcgaagcgacccaccccccacctcctccttgcggtttccctctccgtttccgttctcctcccgctgctcttgccggcggcggtggcggtggcggagggagatggggagatcaagtcggccctgggggccgggaggcagtgggcgaccgggaaggacaagggggagctggttgcggagggggatactgctggaggcgggtcggtggaggaggacgagttcgcgggtggcttcggctccctcgacagcatgctgcagtgggcgatcggaaattctgatccggagaagctgaaagaggaggcggctgatgtgcagaagttgtctgcagatgagctgcttaagcggcgccaggagatcaaggagttgatggagaagttaaagatgccatccgatgctgacttaatgaaaattgcaattgctgacttaaaaaattcttccatttctctggaggatcgccaacgcgcgttgcaggaacttttagttcttgttgagcccattgacaatgctaatgatcttgacaaacttgggggcctccttcctgtgattcaagagcttaataatgcaaatgaagaaatacggaccacctctgcttgggtccttggtacagccagtcagaataatgcgcatgtacaaaaccagatcctcggttatggagctttggcaaggttagtgaagatgggctattctacatcttcagaagaagctgcaaaagcattatatgctatatctgctttgatcagaaacaatgtaaatggtcaagaggcattccgttcagaaaatgggagtgcaatgttgcagcacatattggtgagcaacagtattgatgttaggctacagaagaaggcagtgtttttagtgacagatctggctgactttcagctaaattctggaaacccacaacttcctttcttaagtgaccgccttttcctgaagtcaataattgatatgttgtcaaggtttgacctagatctccatgaaaaggttttgttggccattaagagtctactgaaactttcctcaactgatgcggatgactttgagttctatgacctcgggggtgtactgctcagactaggggtgcagttggaggacttgacacctgaagatcaaaaggagttcgctggggaagttgatgcccttcgaagagaagttgaggctctcttccaacagaagctcaagcagggtaaagcgagcgcgacctgatatttttggatgaccaccagaaagatttgcccttttggatgcagtgtaatccatcatttttttttgtgggatgttacagttagatggctggtttgggtttctttttctagcaatactcagaatcatcagtcggaagcgacgggaggatgtcaggaagcaatgtggcaagtaatctagcttcggaaatcggaaggagagagccgtggcccgtgggcaagaggtggtcgatgtccttacgtcgctggggcagaagcagaacgagcagttctgcagttgccgtgtccagcgtgcgcgtcagcgcgtggccgcgtgctatggcagtggagggaatcctgcgtgcgtgtgcgccagcccaaaagaagagcttcaccatcgcaggcgactaggcgtacgtgtggcgtgaagccgtcgcacggattcatcaaaaggatatcgccactccagcttatcctccatcaaacaggtttagaccgtgtcatgtggctagctacgggctcgagtcctaacaatctcgtggttgctcgatcgtggggcacgagacccccatgagcaggttagcaagtggcctacctacatctcccgcgcacccgtttgtcatcgagtaaacaaggcaccaccaacttgaggtgtttagg

SEQ ID NO: 2830 - DNA, 2366 bp, Trigonella foenum-graecum
agattgaaggttcagcagctttctgatggtactagaagtccagttactgttaggcatcctaaacgaatttcaaactccattctcaatggagaaggagaaggagaagaagatggggatgtagttactggttcaagtggtcattctcatgaaattgataatgaaattgttagcactgatattagtagttgtagctcaggcgggtcggagaattgggtattgttgtcaatttctggggataagcccgctcctagattcaatcatgccgccgctgtaattgggaataagatcatagtggttggcggtgagtcagctactggattgctcgatgatgtgcaggtgttgaattttgacacattttcgtggaccatggcatcatcaaagctttacttgtctcccagcagtctgcccctaaagattcctgcatgcaagggtcattgtttggtatcatatgggaaaaaggcacttctcatcggagggaaaacggatcccggaagtgacagaatttcagtatgggcatttgatacagaaagtgagtgctggtcactcatggaggcaaagggagacataccggttgcccgcaatggtcacagtgttgttagggcaagctcttatttgatattgtttgggggtgaagatgcaaaaaggaggaaactgaatgatctacatatgtttgatctcaagtcgttgacatggcttccacttcactacacaggaacagcaccttctccaagactgaaccatgtagcagctctctatgatgataaagttctttatatatttggaggatcctcaaaatccaagaccttaaatgatttatattcgcttgactttgaaacaatggcatggtcaagagtaaaggttcgaggtttccatccatcacctagagctggttgttgtggtatcttgtgtggtactaaatggtatattacagggggtggaagcaagaaaaaacgacatggagagactctgatttttgatactgtaaaaaatgaatggtctgtgacaattacttcacctccatcttctatcactaccaacaagggtttcagcttagtacttgtgcaatacaaggaaaaagactatcttgttgcatttgggggatccaaaaaagagccatctaatcaggtggaagtgttggaattggataagaatgagtcggcacttagaagacgttcaactcccagtaaaggtcctgcgtctatactgcttgaaaaacattcatcatccactagattagcctctcagcttaatcactgttcccaacgcttagttgactctgttgctagacaaaatttagcatctgcagttgaacatggttctggaaggaaatccctttccgaatctgtagatccccattaccccccaaccaatgtctcccttcgaaagcaatttgatcgcgatgaagaatacaatgcagatgtcaagatggacaagaactcagatggaagttctttaccacaggcagcagatcacagaacaaatgaaaatggacgtggtaaactgatgaacattagtggagccaaggtcaatattgaaggacaggtgttgttgtctgggatatcaagtcaacaaaaccaagtatttgaaaatgatgcactagaaagtgatgtgtcttttcccgagaatgataaatcaggatcactttcttctacaaatatctatcaatattatgaaagcaaagtagcggccctaataaggaaaaatggtgtgctggagggtcaactggcagcttccatggcaagcagagaagttgcagagaaaaacttagcatctgttcataaaaataggcaggaaatggagaaaaaattggccgatgcactgaaagagatggaattactgcgagagaagctagccggtctagagttggcccaagaagaagctaacaatttatcaaacattgtccactctgacaacgttcggcttgagcatgatgtggccttcctcaaggctgttttagatgatacacagaaggagttgcactcaacacgaggagttattgcaggagaaagagctagggcgttccaactacagtatgaagtttttcatctcaaacagagattgcaatcgatggaaaatcggacatctactacacccaggaagccgtttcacgtgcagtgaagtagataattagagcagctcaccacttggttcctagtttttctgccactttatcatatcaagaagcatctgattgtgtataattttgtctagcattaggtggaaatgtgcatactaagagtactttgtatattaagctagctcgtcctctcagatctatttaaccttcaattagtaacagtgtattgagaacaaccactaataacatattaagaagtaacagataaataaatatgtaaagcttttca

SEQ ID NO: 2831 - DNA, 2815 bp, Glycine max
gtggtaacgtatccaaccaaatccttcttatgcggacctgacactgacactgtgctaacgtgcgcatcctctctctgtctgtcatcttcagtcccttgcagctaatgtttctttctttcttcattgaacacacatatcctaatccgacgtcgtttctcaaacacagctgtgctgtgcagggttaccttttccctttccccttttgctctcattattggcaaccactcttccaggctggctgacgtcataatgtgccttcccttttagggtttttactacttacttctccatctctccggttttttcttcttcctttcatcaacatgtttggcttttctcgtcgccgtatgaaacttggaagattgaaggtgcagctttctgaggccaatcccggaaccagaactcccgtcagacccccaaaacggaacggaacggaaattggagatgcagctggagggtctagtggtcattctgatgaagttgattgccagccttcaactgagataactagttgtggcagctcagagaactggatggtcttgtctattgccggggataaacccattcctagatccaatcatgcagcagcagtcattgggaataagatgatagtcgtgggcggcgaatccgggactggattgttggatgacgtgcaggtgctgaattttgatagattttcgtggaccaccgcatcgtcaaagctttacttgtctcccagcagtctgccactgaaaattccagcgtgcaagggccatagtttggtatcctgggggaaaaaagcactgctcattggagggaaaacagacccaggaagtgacagaatttcagtatgggcatttgatacagagacagagtgctggtcactcatggaggccaagggggacataccggttgctcgcagtggtcatagtgttgttagagcgagctctgttttaatattgtttggtggtgaggatgcaaaaaggaggaaattgaatgatctacatatgttcgatctcaagtccttaacatggcttccacttcactacacgggaacagcaccttctccaagattcaaccatgtagctgctctttatgatgataaaattctttatatatttggaggatcatcaaaatccaggaccttaaatgatttatattcacttgactttgaaactatggcatggtcacgagtgaagatgcgaggttttcatccgtcacctagagctggttgttgtggtgtcctttgtggtactaaatggtatatcacaggtggtggaagccggaaaaaaagacacggagagactgtgatatttgatattgtaaaaaatgaatggtctgtggcaatcacttcgcctccatcttctatcactacaaacaagggtttcagcatggtactcgtgcagcacaaggaaaaggattttcttgttgcatttgggggatccaaaaaagagccatcaaatcaggtagaggtgttgataatggaaaagaatgaatcagcactagggagacaatcagctcccagtaaatgttcagcatctgtactacttgaaaaacattcatcatccactagattggccccccaacttaatgattgttctcaacgtttagttgactcagttgctagacaaaatctagcttctgcaattgaacatggttccggcaggagatctctatcagaatccctggttgttgatcccaattttcccccaaccaacacctcccttcgtaagcaatttgatcacgatgaagaatacaatactgatctcaagatggacaagaactcagatgaaaattctttccctcgggcagtagatcacagaacaaacgaaaatgaccatggtaaacagatgaatagtagtggagccaagaacattacggaggaacaacaggcactgttatctggaattccaatccaacaaaacctagtatttgaaaatgacatgctagaaagtgataacgtgtcatttactgaaaacattaaatcaggatcactgactacttcaaatgtctatcattgctatgaaagtaaattggcttccctgataaggaaaaatggaattctggagggacaattagcagcttccttagcaagcaaagaagccgcagagaaaagtttggcatctgttctcaaaagtagacaggaaatggagaggaaattggcggaatcacataaggagatggaattgatgagagagaagctgaccagtctagagttggcccaggaagaggccaacaacctatcaaacattgtgcactctgacaatgtacggcttgagcatgatgtggccttcctcaaggctgttttagatgatacacagaaggagttgcactcaacaagaggagttattgcaggagaaagagcaagagcattccaactacagtatgaagtttttcatctcaaacagagattgcaatcaatggaaaatcgagcatctactacaccgagaaaaccgttccatgtgcagtgaggtgatgtttgtttgaagttgcttattccacttaattcgatgtgtacatatatttgaaccaatgaatcaccgttagtagttcttctggaaggttctaaaagtgagagcaacttgttttagaatgtcaagtaaattattgataagaaaattaatgtttaatattacgtattcatgcattggatattattttgtttattttcttatcattgactaaaattatttattttacttatttactttacaagactcaaattctttcttaaattatgtactttcaactttttttcttcttccattacatccaaacttacctatagtgtaaacctatgtgaatgcaagattagtatgtaaaattattcactaaa

SEQ ID NO: 2832 - DNA, 2623 bp, Phaseolus vulgaris
tctcattattgtgaatctgattagtattattacccacttttctggacacagcatcccaaaccaaaccacagaaactctttcagagactcatatcaaataatgtgtcttccctttctacctttttagggttacttcctcactcactcactcactcaatcttcatccttctctgttttaccttttcttctaccttcctttcttctctctcctctttttatcaacatgtttggcttctctcgtcgtcgtatgaaacttggcagattgaaggtgcagctttctgaggccaaccagggaaccagaactcccatcaggcaccccaaacgaaatggaaactccaatggagaaggagatgcagggtctagtggccattctgatgaagttgattgcctgccttcgactgagataagtagttgtgcatcaggtagctcagagaactggatggtgttatctattgctggggataagcccactcctagatccaatcatgcagcagcagtcattgggaataagatggtagtggtaggcggtgaatctgggactggcttgttggatgatgtacaggtgctgaattttgatagattttcatggaccaaggcatcgtcaaagctttacttatcaccaagcagtctgccactgaagattccagcatgcaagggccatagtttggtatcctggggcaaaaaggcacttctaattggagggaaaacagacccgggaagtgacagaatttcagtatgggcattggatacagagacagagtgctggtcactgatggaggcgaagggagacataccagttgctcgcagtggtcacagtgttgttagagcgggcactgttttaatattatttggtggtgaggatgctaaaaggaggaagctgaacgatctgcacatgtttgatctcaagtcctttacatggcttccacttcactacacgggaacagcaccttctcccagattcaaccatgttgctgctctctatgatgataaaattctttatatatttggaggatcatcaaaatccaggaccttaaatgatttatattcacttgactttgaaacgatggcatggtcgagagtaaagatacgaggttttcatccatcacccagagctggttgttgtggtgtcctatgtggcactaaatggtatattacagggggtggaagcaggaaaaaaagacatggagagactgtgatatttgatattgtaaaaaatgaatggtctgtggcaatcacttcgcctccatcttctatctctacaaataagggtttcagcatggtacttgtgcagcacaaggaaaaggattttcttgttgcatttgggggatccaaaaaagaggcatccaatcaggtagaagtgttgataatggaaaagaacgaatcagcagtagggagacaatcagctcccggtaaatgttcagcatctgtactacttgaaaaacattcatcatcagctagatttgcctcccaacttaaagattgttcccagaatttagttgactcagttgctagacaaaatctggcttctgcaatagaacatggttctggcaggagatctctgtcagaatccctggttgttgaccccaatttcccccccaccaacacctcccttcgtaagcaatttgatcatgatgaagaatacaatactgatctcaagatggacaagaactcagatgaaagttctttccctcggtctggagatcacagaacaaatgaaaatcaccatggcaaacagatgaacacttgtgggaccaagaccaatatagaggaacaggcaatgttatccgggattccaaaccaacaaaacctagtatttgaaaatgaaatgccagaaagtgataatttgtcattttctgaaaacaataaatcagcatcactgtcttcttcaaatgtctatcattactatgaaagtaaagtggcttccctgataaggaaaaatggaattttggagggacaactggcagcttccctggcaagcaaagaagctgccgagaaaagcttgacgtctgttcttaaaagtaggcaggaaatggagaggaaattggcagatgcacataaggagatggaattgatgagagagaagctggccagtctagagttggcccaggaggaggccaacaacctatcaaacattgtgcattctgacaatgtacggcttgagcatgatgtggccttccttaaggctgtattagatgatactcagaaggagctgcattctacaagaggagttattgccggggaaagagcaagggcatttcaactacagtatgaagtttttcatctcaaacagagattgcaatcaatggaaaatcgagcatctactacacccaggaaaccgtttcatgtccagtgatgtgaatgttcgaagtagctcattccacttaaatatttgatgtgtacatatattcgaaccactgaatcacaccatacaagtgctgtgttttttgccattgtccatatcaagaagcatcgactatgtaaatatatttgtttttacttaataattctaatttctatctatatttgagggcaatgattccgtggatgaagttcaagtttggtgtaaatcttgaggcatttcctttctttctataacacgttaaagatatttttatttgtctaaa

SEQ ID NO: 2833 - DNA, 2778 bp, Glycine max
gtaatatccaacaaaatccttcatatgcggacctgacactgtgctaacgtgcgcatcctctctctgtctgtctctatgttctgtcatctcatcttaactttgcttcttcacttccttccagctaatgcctaattaacttgcttctttctttcttccttcttcattcagcacacttacatatcctaatccgacgtcgtttttcaaactcacaccatagctgtgtagtgcagggcagggttaccttttccttttccacttttgctctctttctttctgggcacagcaaagaaactaactctttcaggactcaggctggctcatgtcataatgtgccttccctttctggccttttagggtttttacttctccatctctctccatttttttcttcttccttcctgctgctgctggcatttacctttcatcaacatgtttggcatttctcgtcgccgtatgaaacttggcagattgaaggtgcagctttctgaggccaatccgggaaccagaactcccatcagacaccccaaacggaacggaaactccaatggagaaggagagggagatgctggaggttcaagtggccattctgatgaagttgattgccagccttcaactgagataactagtggcagctcagagaactggatggtcttgtctattgctggggataaacctactcctagatcgaatcatgcagcagctgtcattgggaataagatgatagtggtgggcggtgaatctgggactggattgttggatgacgtgcaggtgctgacttttgatagattttcgtggaccatggcatcgtcaaagctttacttgtcacccagcagtctgccactgaaaattccagcatgcaagggccatagtttggtatcctgggggaaaaaagcactgctcattggagggaaaacggacccaggaagtgacagaatttcagtatgggcatttgatacagagacagagtgctggtcactcatggaggcaaagggggacataccggttgctcgcagtggtcatagtgttgttagagcgagctctgttttaatattgtttggtggtgaggatgcaaaaaggaggaaattgaatgatctacatatgttcgatctcaagtccttaacatggcttccacttcactacacgggaacagcaccttctccaagattcaaccatgtagctgctctttatgatgataaaattctttatatatttggaggatcatcaaaatccaggaccttaaatgatttatattcacttgactttgaaactatggcatggtcacgagtaaagatacgaggttttcatccatcacctagagctggttgttgtgacgtcctttgtggtactaaatggtatatcactgggggtggaagccggaaaaaaagacacggagagactgtgatatttgatattgtaaaaaatgaatggtctgtggcaattacttcgcctccgtcttctatcactacaaacaagggtttcagcatggtacttgtgcagcacaaggaaaaagattttcttgttgcatttgggggatccaaaaaagaaccatcaaatcaggtggaggtgttgataatggaaaagaatgaatcaacattggggagccaatcagctcacagtaaatgttcagcatcagtactacttgaaaaacattcatcatctactagattggccccccaacttaatgattgttctcaacatttagttgactcagttgctagacaaaatctagcttctgcaattgaacatggttccggcaggagatctctgtcagaatccctggttattgatcccaatttcccccccaccaacacctcccttcgtaagcaatttgatcacgatgaagaatacaataccgatctcaagatggacaagaactcagatgaacgttcttttcctcgggccgtagatcacagaacgaacaaagattaccatggtaaacagatgaatactagtgaagtcaagaccaatatggaggaacaacaaacattgttatctggaattctaaaccaacaaaacctagtatttgaaaatgacatgccagaaagtgataatttgttattcagtgaaaacattaacattaacattaattcaggatcactgactacttcaaatgtctattattactatgaaagtaaattggcttctctaataaggaagaatggaattttggagggacaattagcagcttccatagcgagcaaagaagcggcagagaaaagcttgacttctgttcttaaaagtaggcaggaaatggataggaaattgacagaatcagagaaggagatggaattgatgagagagaagctggctggtctagagttggcccaggaagagaccaacaacctatcaaacattgtgcattctgacaatgtacggctagagcatgatgttgccttcctcaaggctgttttagatgatacacaaaaggagttgcactcgacaagaggagttattgcaggagaaagagcaagggcattccaacttcagtttgaagtttttcatctcaaacaaagattgcagtcaatggaaaaaaatcgagcatctactactccgaggaaaccatttcatgtacagtgaagtggatgtttgaactttgaagtagcttattccagttttttttttatgtttttagagaagcatattccacttaagaatttgatgtgtacatatatttgaaccacagtgaataaccaactttttctcttcactgtcacaagaagcactctgggtaaatatatatgctataagggaattaattctgagtttcaagtctggtat

SEQ ID NO: 2834 - DNA, 2888 bp, Zea mays
ttcttttccccctcccctgttaaacacgcgcagcgaagcaacgcagcagcaacaaaccttttcgctcgcagctgccaccacctcgtcgtctcgcctccccctcggcctccgcacgcgcgcgcgggatctcgccctcgcccgcctcgccgctcgcgcgcgcgcaccgaggaagggcgcacccacccgcaggcttcctggcgggccgatacggcggcgatggcgagccgggtcaaggaggacgagaggcacgagaagatccttcgcggcctgctcaagctgcccgccaacaagcgctgcatcaactgtaacaatttgggaccacaatatgcctgcacaaatttctggaccttcgtttgtaccaattgcagtggagcacatcgggagttcacgcatcgagtaaaatcggtttccatggccaaatttactgcacaagaagttactgcccttcaagaaggggggaatgagcgtgctagagaagtatttttcaaggagtgggatcctcaacgaaatggataccctgacagcagtaatgctgacaaattgagaaatttcattaagcatgtgtatgtggaacggagatacacaggagaaagaagtactgataagccaccaagggcaaaggatgacaaggatgagtatagtgaaaataggagatctgatggaaattggggtggttcaagaagtccgccagatggaagttactctgatcgtcggagttatagtggacggagtgatgacagaaattccagatattcctatggggaccgtagtcctggctatgaccaaaatgactataagaaaagtcctcgctactttgaggttgtcgatgatagatctggaaaaacaactccagttcaaaggtttgaagaccgttggtcttcggagcccagaaaaccagatagtggatctccagatttccagaaagaagctgatggttctagtcctgttgtacgaccagttagggatatattgggtgacaatactcctcaacttcgggttggtgaaccgtcaaagccagctactgaacctccaaagccaagcgtagtcagaccaattgatcctccaaagccgagtgtagtcagaccaattggtcctccaaagccaaatggaaccagggcaattgatcctccaccactgacaaagacaatatctagtgccagcagcattggttcttcagaaggcacatcagaacagacaaaggtggcaagtgctgtaagtttaattgattttagtgcagatcctgaacctgcgtccacagcaccaccacaacccacccctatgccacaacaacctccatttaacgcagcagcaccacagcctattcttgaacaagggaaaagtgatccttctgtcagtggtggtgactgggcatcttttgattcttttggccaacaacaaacaccacaaacaagcagcagtgtaaatcctcttgagtctgcacttgcacagctgtcattctctgaagcaccctctgcaccaaatgcgtcagcttatcctgtttctcttgatcccactttgaaagcaaatgatggaggacattcatctgtgctagaccagtcacattccttgtttgatgcgccctttggaatctcaggcaaccaggcctcaacagtaatgtccggccaaggatcatcagttcaacaatctcctctagctgccccaacagctggacctccatctcaagctactgcaaatccacaaggaaccagtggtattcaaggagcagcctcttctactgacagtaaattcagtagcaggaaagaacttccagtggatatctttactgcactatatccaccatcaactcaaatgatgcctggctggcagagagctccccattttggaatgggatacgccatgcaatatccacctggagtgggattgcaatcatatcttcacggagcatttcctcagcctacatatcagcaacctgtatattcacaacatgcatattcccacccccaacctgtgaaagcttcaaacccttttgatcttgggaatgagtcagctcatattcaagctcacatgcccccatctgggccacctggagcatcagcaggctcagctccccaaaccttaattggtaactctagttttggtgttcctccacagcagcctcaccagctctatcagtcagaagcgcatctaagccattttatgatgcagcaagttccgaacagcatgcccatgcctgaacaacaacctaatagcatgcttgcaacgcaacaaggtttgggttccttcaacatgggttttgatcaggaagctcctctcggatacccccaggcaaacacctcaccttcctacggctccgttggtggtggtagtaatccatttggctgaaagaagtgtggaaatacctgatcgttcatcactagacgaagggtctgcagcactcagggggacagacatgcatcgaagccctggagagattgtgtttcatacaacaaggtggtgtatcttgtcggccgtagtctgttgtacaacttgtttccaaaggcttaatgatcgaatataactctgttttggagggcctaagctgatttcagcctcattccatgtacattgtgtctggcgttctgcttggattgcacagtatgtatattgtgtttcttcgttgttgtcatggacagtgtcagctcctgttttagtacaagttgtttctagtgcacttgattattcgatttaatgtggatgattagtacactatagatcagatgtagaatcgtgatcgatcaattttgtggtttctttttacttgctatcttagtaccacttaattttgtggtgatcttttgtaagggttattttcttgtggaactcattacttgttatctacattttgtaatgcaattcaaggtatgttcaacttaactaatttctccctc

SEQ ID NO: 2835 - DNA, 2898 bp, Zea mays
gttgcagctgtttggactgctgcagctgcaatccatagagagaaaaatactgtagaagccgcagccgcagccggattgcagccgcagcaagccgcagcgaacaagctggtaatcaccacctgtcgtcgatttagcactcgtcagaaatcattagccagctagctgtctagacaccgccttccccgcgaccggctgcacccggtcacttcttctccccacgcagtcacctccccgcaaaccccacgaggaaaaagtttctttttttctctgttaaacacgcgcatcgaagcaagccagcagcaacaaaagagacgagccttttcgctcgccgctaccaccacctcgttgtctcgcctccgcctcggcctcagcacgcgcgcgggatctcgcgctcgctcgcgcaccgaggagcgcgcacccacccgcagggttcggggcggggtgatccggtggtgatggcgagccggatcaaggaggacgagaggcacgagaagatcatccgcggcctgctgaagctgcccgccaacaagcgctgcatcaactgcaataatttgggaccacaatatgtctgcacaaatttctggacctttgtttgtaccaattgcagtggatcacatcgggagtttacacatcgagtaaaatctgtttccatggccaaatttaccgcacaagaagttgctgcccttcaagaaggggggaatgagcgtgctagagaagtatttttcaaggaatgggatcctcaacgaaatggataccctgacagcagtaacgctgacaaattgagaaatttcattaagcatgtgtatgtggaacgtagatacacaggagaaaggagtactgataggccaccaagggcaaaggatgacaaggatgagtatagtgaaaatagaagatctgatggaaattggggtggttcgagaagtccgccaaatggaagttactctgatcgtcagaattatagcggacggagtgatgacagaaattccagatattcctatggggaccgtagtcctggctatgaccaaaatgactataagagaagtcctcgctactttgaggttggtgataatagatctggaaaaataactccaattcaagggtttgaagacaggaggttttcagagcccagaaagcgagatagtgggtctccagacttccagaaagaagctgatggttctagtcctgttgtacggccagtgagggatatattgggtgacaacgctcctcaacttcgggtcggtgaaccttcaaagccagctactgagcctgcaaagccaactgtagtcagaccaattgatcctccaaagccaagtgtagtcagaccaattgatcctccgaagccaaatggaaccagggcaattgatcctccaccactgacaaagacaatatctagtgccagcagcattggttctgcagaagggacatcggaacagacaaaggtggcaagtgcagtgagtttgattgatttcagtgcagatcctgaacctgagtccacagcaccaccacagccggcccctatgacacaacagcctccagttaatgcagtagcaccacagcctgttcttgaacaaaggaaaagtgctccttctgtcagtggtggtgattgggcatcttttgatgcttttggccaacaacaaacacctcaaacaagcagcagtgtaaatccccttgagtctgcacttgcacagctgtcattctctgaagcaccctctgcaccaaatgtgtcagcttatcctgtttctctggatcccactttgaaagcaaatgatggaggatattcatctgtgctagatcagtcacattccttgtttgatgcaccctttggaatctcaggcaaccaggcctcaacagtaatgtctggccaagaaacatcggttcaacaatcttctatagctgcccctacggctggacttccatctcaagctactgcaaatcaacaaggaaccagtggtattcaaggagcagcttcttctactgacagtaaattcagtggcaggaaagaacttccagcggatatctttactgcactatatccaccatcaactccaatgatgcctggttggcagagagccccccattttggaatgggatacgccatgcaatatccacctggagtgttccagggaatgcaagcatatcctcagcctacatatcagcaacctgtatattcgcaacatgcatattcccacccccaacctgtgaaagcttcaaacccttttgatcttgggaatgggccagctccaactcaagctcacatgcccccatctggaccaccaggagtattagcaggcccagctccccaaaccttaattagcaactctagttttggtgttcctccacagcagcctcaccagctctatcaatcagccgcacatccaagccatttcatgatgcagcaagttccgaacagcatgcccatgcccgagcaacaacctaatagcatgcttgtaacgcaacaaggtttgggatacctccagccaaacacccccccaccttcatacggctccgttgggggtagtaatccattcgggtaaaagaagtgtgggaatacctgctctttcatctctagactaagggtctgcagcactcagcgggacagacatgcatcgaagccctcgagagaatgtgtttcatacaaccaggtggtgtattctgtcgggtgtgatatgttgtacaacttgtttccaagggcttcatcatcgaatgtaactctgttttagagggcctaagctgctttcagcctcattccttgtatattgtgtctgcttgaattgcatagtatgtatattttgtgttcctctcgttgtccctgtcactatcactagacatagagcatttagcgataaaatgactgggcttaccacatttgcgtcgatgggaagcctacttgatgtagac

SEQ ID NO: 2836 - DNA, 2848 bp, Setaria italica
cccacgaggaaaaactttttttttctcccctgttaattacacgcgcagcgaagcaacgcagcagcaaacaaaagaggcgagccttttcgctcgccgctgccaccgcctcgtcgcctcgcctcggcctcagcacgggcgcgcgggatctcgcgctcgctcggctccccgcccgcgcgcgcgccgaggagggagggcgcacccgtccgcagggtctggggggcgcgcggggcgatccggcggcgatggcgagccgggtcaaagaggacgagaggcacgagcggatcatacggggcctgctcaagctgcccgccaacaagcgctgcatcaactgcaacaatttgggaccacaatatgtctgcacaaatttctggacgttcatctgtaccaattgcagtggagcacatcgggagttcacgcatcgagtgaaatcagtttccatggccaaatttaccgcacaagaagttactgctcttcaagaaggaggaaatgagcgtgctagagaagtattttttaaggaatgggatcctcaacgcaatggataccctgacagcagtaatgctgataaattgagaaatttcattaagcatgcgtatgtggaacggagattcacaggagaaagaagtgccgataggccaccgaggggaaaggatgacaaggacgagtatagtgaaaataggagatctgatgggaattggggtggttcaagaagtccaccaaatggaagttactctgaccgtaggagttatagtggacggagtgatgacagaaactccagatattcctatggagatcgtagtcctggctatgaccaaaatgactataagaaaagtcctcgctactttgaggttgtcgatgatagatctggaaaaacaactccagttcaaaggtttgaggaccgcaggttttccgaaccaaggaagccagatagtgggtctccagactttcagaaagaagcagatggttctggtcctgttgtgcggccagtgagggatatactgggtgacaatgctcctcaacttcgggttggtgagccttcaaagccagctactgaacctccaaagccaattgtagccagaccaattgatcctccaaagccaattgtagccagaccaattgatcctccaaagccaaatggaaccagagcaattgatcctccaccactagcaaagacgatgtctagtgccagcagcattgcttcttctgaggggacttcagaaccagtgaaggtcgcaaatgcagtgagtttaattgattttagtgcagatcctgaacctactgcacctgcaccaccaccacagccagcctctacgactcaacagcatcctgttaatgcacctgcaccacagcctgttcttgataaagggaatagtgctccttctgtgagtggtggtgactgggcatcttttgatgcttttggccaacaacaaacgccacaaacaaccagcagtgcaaatccacttgagtctgcacttgcgcaactgtcattctctgaagcaccttctgcaaccaatgtgtcagcttttccagcttcaaatgatcccactttgaaagtgaatgatggaggacacccatccattgtagaccagtcgcataacttgtttgatgcgccctttggaatctcaggcaaccaggcctcaacagtgatgtccaaccaaggatcttcagttcaacaatctcctcttgctgcccctacagctggactcccatctcaagtaactgcaaatccacaaggaaccagtggtattcaaggagcagcatcttctaatgacagtaaatccagtggcaggaaagaacttccagcggatatctttactgcactatatccaacatcaactccaatgatgcccggttggcagagagctccccaatttggaatgggatacggcatgcaatatcctgccggagtgtttcagggaatgcaagcatatcctcaggcagcatttcctcaacctacatatcaacaacctgtatatccgcaacatgcatatccccaacctcaaccccaaccccaaccccaaccccaaccccaaccagtgaaagcttcaaacccttttgatcttgtgaatgatccagttccaattcaagctcctatgcctctatctgggccactaggagcatcagcaggcactactccccaaaccttacttggcacctctagctttggtgttcctccacagcaaactcaccagctctatcagtcagctgcacctccaagccatttcatgatgcaacaagttccaaacagcatgccccagcaaccaccgaatagcatgcatgcagcgcaacaaggtctgggttccttcaacatgggttttgatcagcaagctccacccagatacccccagccaagcaccccaccttacggctccgttgggggtagcaatccgtttggataaaagaactatcaaatgtggaaatacctgctctttcatctccagaccaagggtttgcagcacatagcaggacgaacatgcatcgaaaccctcaagagaatgtgtttcatacaaccggttgtgtattttgttgggcgtaatccgttgtacttgtttacattgggtcaatgatcaaatgtaactctgttttggagggcgtaagctgcatgcatccccattccttgtatattttgtgcccgccacattctgcttgtatggcatagtttgtatatttcgtattcgtttgttatcttggacagtatcggatctattattagctcagcatgtcgtttctagtgcagttggctattcaatatactgtggatgacaatatcggactgtatactcgatcaggtgtataattgtgatcaatcaattttgtgatttatatagcaatactgtgaagttaccattaa

SEQ ID NO: 2837 - DNA, 2613 bp, Pennisetum glaucum
gccgaggagggagggcgcacccgtccgcagggtcctgggggcacgcgcggggcgatccggcggcgatggcgagccgggtcaaggaggacgagaggcacgagcggatcatacgggggctgctcaagctgcctgccaacaagcgctgcatcaactgcaacaatttgggaccacaatatgtctgcacaaatttctggaccttcatctgtaccaattgcagtggagcacatcgggagttcacgcatcgagtaaaatcagtttccatggccaaatttaccgcacaagaagttactgctcttcaagaaggaggaaatgagcgtgctagagaagtatttttcaaggaatgggatcctcaacgcaatggataccctgacagcagtaatgctgataaattgagaaatttcattaagcatgcgtatgtggaacggagattcactggagaaagaagtgctgataagccaccgaggggaaaggatgacagggatgagtatagtgagaataggagatctgatgggaattggggtggttcaagaagtccaccaaatggaagttactctgaccgtcgaagttatagtggtcggagtgatgacagaaactccaggtattcctatggagatcgtagtcctggctatgaccaaaatgactataagaaaagtcctcgctactttgaggttgttgatgatagatctggaaaaacaactccagttcaaaggtttgaggaccgcaggttttccgaaccaagcaagcccgataatgggtctccagactttcagaaagaagcagatggttctagtcctgttgtgcggccagtgagggatatactgggagacaatgctcctcaacttcgggttggtgagccttcaaagccagttactgaacctccaaagccaattgtagccagaccgattgatcctccgaagccaattgtagccagaccaattgatcctccaaagccaaatggaaccagagcaattgatcctccacgactggcaaagacgatgtctagtgccagcagcattgcttcttccgaggggacttcagaaccagcgaaggttgcaaatgcagtgagtttaattgattttagtgcagatcccgaacctgctgcacctctacagccggcctctacgactcaacagcatcctgttaatgcacctgcaccacagcctgttcttgatcaagggaatagtgctccttctgtgagtggtggtgattgggcatcttttgatgcttttggccaacaacaaccgccacaaacaagtggcaatgcaaatccacttgaggttgcacttgcacaactgtcattctctgaagcaccttctgcaaccaatgtgtcagcttttccagcttcaaatgatcccacttcgaaacggaatgatggaggacactcatccattgtagaccagtcgcataacttgtttgatgcaccctttggaatctcaggcaaccaggcctcaacagtgatgtccaaccaaggatcttcagttcaacaatctccttttgctgcacctacagctggacttccaactcaagtaactgcaaatccacaaggaaccagtggtattcaaggagcaacatcttctaatgacagtaaatccagtggcaggaaagaacttccagcggatatctttactgcactatatccaacatcaactccaatgatgcccgggtggcagagagctccccagtttggaatgggatacggcatgcaatatcctgctggagtgtttcagggaatacaagcatatcctcaggcagcatttgctcaacctacatatcagcaacctgtatatccgcaacatggatatccccagcctcagccccagccccaaccacaaccagtgaaatcttccaacccttttgatcttgggaatgagccagttcaagcacatatgcctctatctgggccaccaggagcatcagcaggcacaacttcccaaaccttacttggcacctctagttttggtgttcctccacagcaacctcaccagctctatcaatcagctgcacctccaagccatttcatgattcagcaagttccaaacagcatgccccagcaaccaccgaatagcatgcatgcaatgcaacaaggtctaggatccttcaacatgggttttgatcagcaagccccacccagatacccacagccgagcaccccaccttcctacggctccgttgggggtagcaatccatttggataaacgatcaaatgtggaaatacctgctatttcatctccaggcgaagggtttgcagtgctcaggaggacaaacatgcatcgaaaccctcaagaggatgtgtttcatacaacccgttgtgtattttgtttacacaggaggtcagtcaatgatcaaatgtaactctgttttggagggtgtgagctgcacgcaaccccattccttgtatattttgtgcccgtggcattctgcttggtgcttgtattatggcatagtttgtatattttatattggacagtgtcagatttattattagctaagcatgtcgtttctagtgcagttggctattcaatttactgcggatgataatatctgactgtatactcgatcaggtgtatacttgtttgtgatttgtttagcaatatactgtgttgttacctttaa

SEQ ID NO: 2838 - DNA, 2876 bp, Panicum virgatum
aaccccccacgagggaaaagtttttttttcctcccctgtcaagcacgcgcagcgaagcaaaccagcagcaacaaaagaggcgagccttttgctcgccgctgccaccaccaccaccacctcgtcgcctcgcctcggcctcgcgcgcgcgggatctcgcgctcgctcgccgcgcgcaccgaggaggaaaggagggagggcgctgccgtgcgcgcagggtttggaggcgcggggcgatccggcggcgatggggagccgggtcaaggaggacgagaggcacgagcggatcatacggggcctgctcaagctgcccgccaacaagcgctgcatcaactgcaacaacttgggaccacaatatgtctgcacaaatttctggactttcgtttgtaccaattgcagtggagcacatcgggagttcacacatcgagtgaaatcagtttccatggccaaatttaccgcacaagaagttacggcccttcaagaaggaggaaatgagcgtgctagagaagtatttttcaaggaatgggatcctcaacgcaatggataccctgacagcagtaatgctgataaattgagaaacttcattaagcatgtgtatgtggaacggagatacacaggagaaagaagtactgataggccacctaggggaaaggatgacaaggacgagtatagtgaaaataggagatctgatggaaattggggtggttcaagaagtccaccaaatggaagttattctgaccgtcagagttatagtggacggagtgatgacagaaactccagatattcctatggagatcgtagtcctggctatgaccaaaatgactacaagaaaagtcctcgctactttgagggtgccgatgatagtagatctgtaaaaacgactccggttcaaaggtttgaggaccgcaggttttctgaaccaaggaagcgagatagtggctctccagactttcagaaagaagcagatggttctagtcctgttgtacggccagtgagggatatattgggtgacaatgctcctcaacttcgggttggtgagccttcaaagccagctgctgaacctcggaaaccaattgtagccagaccaattgatcctccaaagacagctgtagccagaccgattgatcctccaaagccaactgtaaccagaacgattgatcctccaaagccaaatggaaccagggcaatcgatcctccaccgctggcaaagacgatgtctagtgccagcagcattgcttcttctgaggggatttcagaaccgacgaaggtcgcaaatgcagtgagtttaattgattttagtgcagatcctgaacctcctgcacctgcagcaccaccacagccggcctctacgactcaaccgcatcctgttaatgcaatggcaccacagcctgttcacgaacaagggaaaagtcctgtgagtggtggtgactgggcatcttttgatgcttttggccaacaacaaacaccacaaaccagcagcagtgcaaactcacttgagtctgcacttgcgcagatgtcattctccgaagcacccgctgcacgaaatgtgtcagcttttccagcctcaattgatcccactctgaaagcgaatggaggacatccatccattgtagatcagtcacataacttgtttgatgcgccctttggaatctcaggcaaccaggcctcaacagtaatgtccaaccaaggatcttcagttcaacaatcacctcttactgcccctacagctggacttccatctcaagtaactgcaaatcaacagggaaccagtggtattcaaggagcaacattttctactgacagtaaatccagtggcaggaaagaacttccagcggatatctttgctgcactatattcaacatcaactccaatgatgcctggttggcaaagagctccccaatttggaatgggatatggcatgcaatatcctgctagagtgttccagggaatgcaaggatatcctcaagcagcgtttcctcagcccacatatcaacaacctgtatatccgcaacatgcatatccccaaacccaaccccagccccaaccccaacctgtgaaagcttcgaatccttttgatcttgggaatgaaccagctccaattcaagctcacatgcccctatctgggccaccaggagcatcagcaggcacaactccccaaacattacttggcacctctagttttggcgttcctccgcaacaacctcaccatctctatcaatcagctgcacccccaagcccttttatgatgcagcaagttccaaacagcatgccccagcaaccaccaaatagcatgcatgcgatgcaacaaggtctgggttccttcaacatgggttttgatcagcaagctcctcccagatacccccagccaggcactccaccttcctacggctctgttgcaggtagcaatccttttgggtaaaagaactatttaatgttgaaatgcctgtactttcatctccagaccaagtgtttgcagcactcagcgggacaaacatgcatcgacaccctcaaagagaatgtgtttcatacaactggttgtgtattttgttgcccgtaatctgttgtacaacttgtctccaagggtcaatgatcgaatgtagctctgttttggagggcgtgagatgcatgcagccccattccttgtatattttgtgtacggcgcattctgcttgtattgcatagtttgtatattttgcattcgtttgttatcttggacaatatcagatctgttagctcagcatgccgtttctagtgcagttgtatattcaatttactgtggatgatataggcctgtatactcgatcaagtgtataattgtgatgacttgtacaatcaattttgttattttgcctactgtcttgggatgatcattcatttca

SEQ ID NO: 2839 - DNA, 2755 bp, Panicum virgatum
gcggcaagcactaccacttgcaccaggccgcccttttcctttgaacctgtacaaccaaacaaaaaactaggtcagatccatccttctcaatcaaacactatatgggttggctccaacccaaaaaaacaaggatggatccgacccatcccacacggtcctcgaaccaaacacatgcttagtggccaagtggacatcggaccacaatatgtctgcacaaatttctggaccttcgtttgtaccaattgcagcggagctcatcgggagttcacacatcgagtgaaatcagtttccatggccaaatttaccgcacaagaagttacggcccttcaagaaggaggaaatgagcgtgctagagaagtattcttcaaggaatgggatcctcaacgcaatggataccctgacagcagtaatgcagataaattgagaaacttcattaagcatgtgtatgtggaacggagatacacaggagaaagaattactgataggccacctaggggaaaggatgacaaagatgagtatagtgaaaataggagatctgatggaaattggggtggttcaagaagtccaccaaatggaagttattctgaccgtcggagttatagtggacggagtgatgagagaaactccagatattcctatggagatcgtagtcctggttgtgaccaaaatgactacaagaaaagtcctcgctactttgagggtgccgatgatagatctggaaaaacgactccggttcaaaggtttgaggaccgcaggttttccgaaccaaggaagccagatagtggctctccagactttcagaaagaagcagatggttctagtcctgttgtacggccagtgagggatatattgggtgacaatgctccccaacttcgggttggtgagccctcgaagacagctgctgaacctccgaaaccaattgtagccagaccaattgatcctccaaagccaactgccagagcgattgatcctccaaagccaactgtagccagaccaattgatcctccaaagccaaatggaaccagggcaatcgatcctccaccgctggcaaagacgatgtctagtgccagcagcattgcttcttctgaggggatttcagaaccggtgaaggttgcaaatgcagtgagtttaattgattttagtgcagatcctgaacctcctgcacctgcagcaccaccacagccggcctctatgactcaacagcatcctgttaatgcaatggcaccacagcctgttcatgaacaagggaaaagtcctgtgagtggtggtgactgggcatcttttgatgcttttggccaacaacaaacaccacaaacaagcagcagtgcaaacccacttgagtctgcacttgcgcagctgtcattctctgaagcaccctctgcacgtaatgtgtcagcttttccagcttcagttgatcccactctgaaagtgaatgacggaggacattcatccattgtagatcagtcacataacttgtttgatgcgccctttggaatctcaggcaaccaggcctcaacagtaatgtccaaccaaggatcttcagttcaacaatcacctcttactgcccctacagctggacttccatctcaagtaactgcaaatcaacaaggaaccagtggtattcaaggagcagcatcttctactgacagtaaatccagtggcaggaaagaacttccagcggatatctttgctgcactatatccaacatcaactccaatgatgcctggttggcaaagagctccccaattcggaatgggatatggcatgcaatatcctgctggagtgttccagggaatgcaaggatatcctcgagcagcatttcctcaacccacatatcaacaacctgtatatccgcaacatgcatatccccaaccccaaccccaaccccaaccccaaccccaacctgtgaaagcttcaaatccttttgatcttgggaatgaaccagcttcaattcaagctcacatgcccctatctgggccaccaggagcatcagctggcacaactccccaaaccatacttgggacctctagttttggcgttcccccacagcaacctcaccagctctatcaatcggctgcacctccaagccctttcatgatgcagcaagttccaaatagcatgccccagcaaccacctaatagcatgcatgcaatgcaacaaggtttgggttcattcaacatgggttttgatcagcaagttcctcccagatacccccagccaggcaccccaccttcctacggctctgttgcgggtagcaatccttttgggtaaaagaactattcaatgttgaaatacctgtactttcatctccagaccaagggtttgcaacactcagcgggacaaacatgcatggacatcctcaaagagaatgtgtttcatacaaccggttgtgtattttgttgcccgtaatctgttgtacaacttgtttccaagggtcaatgatcgaatgtaactcagttttggagggcgtgagatgcatgcagctccattccttgtatatttgtgtccggtgcattctgcttgtattgcgtagtttgtatatttttgcattcgtttgttatcttggacgatatcagatctattagctcagcatgccgtttctagtgcagttggatattcaatttactgtggatcatataggactgtgtactcgatcaagtgtataattgtgatgattagtacaatcaattttgttattttgcctattgtgtaggcatttgggaagatcattcatttcatgaaccgtttttaagga

SEQ ID NO: 2840 - DNA, 1761 bp, Sorghum bicolor
aatcgatccccaatccgttcaggcctccccgatctcgccgtcaccgccctccactccggccgccgccgccgccgccgctctccatcataaacaatccacccctcgtcgcctcgcgtccgtctcctggaccaacgtactccccccttctcctacttgtaattcccctccttctgcttgtgcggcaggggcctcttccgcgcggatggggaagcacgagttcctgacgccgaaggcgatcgcgaaccggatcaaggcaaaggggctgcagaagctgcggtggtactgccagatgtgccagaagcagtgccgcgacgagaacgggttcaagtgccactgcatgtcggagtcgcaccagcggcagatgcaggtgttcggcatggcgcccgaccgcgtcgtcgagggcttctccgaggagttcctcgagtccttcctctccctcatccgccgcgcgcaccgccactcccgcgtcgccgccaccgtcgtctacaacgagtacatcgcggaccgtcaccacgtccacatgaactccacgcgctgggccacgctcaccgagttcgtcaagttccttgggcgcgaggggtactgcaaggtcgaggacacgcccaaggggtggttcatgacctacatcgaccgtgactcagagaaggccgtcaaggaccgcctcaagcgcaagaggatcaagtcagacatggctgaggacgagcgccaggagcgcatgatcgcccgccagattgagcgtgcacacaagtccttagccaaacccgatgatggtgatgctgccgagggcgagcctgagtccggcagtgaagaagagtattcaggctcagacgatgatggggaggagcgtgaggatggctcaaaagaggcaagcaaggcaacagggaagattgcaattgcgcttcagaaggctgtgccagggcccaaggttaatccttttgaggataagccgaaggtgaaatttggtttcgacgaggatgacacaggtaccggagagaaaaaggatgaggcggccaagaacaagggaaaggatgtgaaggcaacagaggcaaggaggtcagcattggatgacctgatgaaggaggaggagaaggccaaggagaggagcaataggaaggactactggctgtgccctgggattgtggtcaaggtgatgagcaagacattggcagagaagggatactacaagcagaaaggggtggtgaagaaagttatcgataaatatgttggggagattgagatgttggagagcaagcatgttctcagggttgaccaagatgagcttgagaccgtgatccctcagattggtggactggtgcggattgtgaatggggcttatcgggggtcaaatgccaggttgctctcagtggacactgcaaaattcagtgcaaaagtgcaggttgagaaaggcctctatgatgggaaggttcttagggctgtcgaatacgaggacatttgcaagatatcctcatgatatacaacgtgattcatcccattttcctggatcatcactgaaagcaaacaagcgctatgcgatccagtgtactagctgtgccaattagatgtgtttgtgcttgctgttgctcgtgcatatcttctgtggaagcagttttcaatatgctgatgtttctgtttcactgtaactgctgaaaggctatctgtgagaaaatggtgtctatgtttgctttttactagaccaggataaccgtattgacaattttgtaatatttggttaacttctatatttctgtttctatttaatct

SEQ ID NO: 2841 - DNA, 1850 bp, Setaria italica
atcccaatcaatccccaattcgttcacgcctccccggtctcgccggcgccgccgcctccctcctctccggccgccaccgtcaccgccacttcccgtcctaaaggccccacctctcgtcactccccactctcaaataaacagatctacacaaagctcccctccttctcccgcttgggcggcaggggcggcggcggcggcgcgatggggaagtctgacttcctgacgccgaaggcgatcgcgaaccggatcaaggcgaagggtctgcagaagctgcggtggtactgccagatgtgccagaagcagtgccgcgacgagaacgggttcaagtgccactgcatgtcggagtcgcaccagcggcagatgcaggtgttcggcatggcgcccgagcgcgtcgtggagggcttctccgaggagttcctcgagaccttcctcgccctgatccgccgcgcgcaccgccactcccgcgtcgccgccaccgtcgtctacaacgagtacatcgccgaccggcaccacgtccacatgaactccaccaggtgggccacgctcaccgagttcgtcaagttcctggggcgcgagggctactgcaaggtcgaggacacgcccaaggggtggttcatgacctacatcgaccgtgactcggagcaggccgtcaaggcgcgcctcaagcgcaagaggatcaagtcagacatggctgaggacgagcgccaggagcgcatgatcgctcgccagatcgagcgtgctcagaagtccctagccaaagccaatgatggtgatgaaggtaatgttgccgagggtgagtccgaatctgagtccggcagtgaagaagattattcaggttcggatgatgatggagaggaacgggaggatgactcaaaagaggccaacaaggcaacagggaagattgcgattgctcttcagaagtctgtgccagggccgaaggttaatcctttcgaggataagccaaaggtgaattttggtttcgatgaagaggactctggtgtccgagagaagaaggatgaggtggacaagaagaaggggaaggatgtgaaagcagcagaagcaaggaggtcagcattggatgagcttatgaaggaggaggagaaggccaaggagaggagcaacagaaaggactactggctgtgccctgggattgtggtcaaggtgatgagtaagtcattggctgagaaggggtactacaagcagaaaggggtggtgaagaaagtgattgataaatatgttggggagattgagatgttggagagcaagcatgttctcagggtcgaccaagatgagcttgagactgtgatccctcagattggtgggctggtgcggattgtgaatggggcttatcgggggtcgaaggctaggttgctctcagtggatacagagaaattctgtgcaaaagtgcaggttgagaaaggcctctatgatgggaagattctcagggctgtcgaatatgaggacatttgcaagatttcctcatgatatgattcatttcatttcctggatcatcgctgaagcaaacaagagccatatgatctagggtactagctctgtcacttagatgcctgacagcgtctgtgcttgttattactcgtgatggaatatcttctgttgaaggggttcaatgtgttgatgtttctagttccatgtaactgctgaagggctatgtgtgagacaatggtggtatcatgtgtgtttccttgttactaaaccagaatacctgttattggcaattttgtaatatctggttaacttctatattgctgtatctagtgaatctttcagcagatattttcttggtattttgagcattacctgccaatcagttcttttgataaggttgtcat

SEQ ID NO: 2842 - DNA, 1710 bp, Pennisetum glaucum
ctccctggactcgccggcgcctcctcctctccggccgccaccactttccgtcctagaagcctctctccccaccctcaaataaacagatctacgcaggggcgccggtgtcggcgtcgacgcgatggggaaatctgatttcctgacgcccaaggcgatcgcgaaccggatcaaggcgaagggtctgcagaagctgcggtggtactgccagatgtgccagaaacagtgccgcgacgagaacgggttcaagtgccactgcatgtcggagtcgcaccagcggcagatgcaggtgttcggcatggcgcccgagcgcgtcgtggagggtttctccgaggagttcctggagaccttcctcgccctgatccgccgcgcgcaccgccattcccgcgtcgcagccaccgtcgtttacaacgagtacatcgccgaccggcaccacgtccacatgaactccaccaggtgggccacgctcaccgagttcgtcaagttccttggacgagagggctactgcaaggtcgaggacacgcccaaggggtggttcatgacctacatcgaccgtgactcggagcaggccgtcaaggcgcgcctcaagcgcaagaggatcaagtcagacatggctgaggacgagcgccaggagcgcatgattgctcgccagattgagcgtgctcagaaatccctagccaaagccaatgatggtgatgaaggtaatgtcgctgagggtgagtccgagtctgagtccggcagtgaagaagattattcaggctcggatgatgatggagaggaacaggaggatggcccaaaagaggctaacaaggcaacagggaagattgcgattgctcttcagaagtctgcgcccgggccgaaggttaatcctttcgaggataagccaaaggtaaactttggtttcgatgaagaggactctggtgtccgagagaagaaggatgaggtggacaagaagaaggggaaggatgtgaaagcagcagaggcaaggaggtcagcattggatgagcttatgaaggaggaggagaaggccaaggagaggagcaaccgaaaggactactggctgtgccctgggattgtggtcaaggtgatgagtaagtcattggctgagaaggggtactacaagcagaaaggggtggtgaagaaagtgatcgataaatatgttggagagattgagatgttggagagcaagcatgttctcagggttgaccaagatgagcttgagactgtgatcccccagattggtgggctggtgcggattgtgaatggggcttatcgggggtctaatgctaggttgctctcagtggatacagagaaattttgtgcaaaagtgcaggttgagaaaggcctctatgatgggaaggttctcagggctgtggaatatgaagacatttgcaagatttcctcatgatattattcatttcatctcctggatcatcgctgaagcaagcaagagctatatagtctagggttctagctttgtcacttagatgcctgatagcatctatgcttgttattacttgtgctggaatatcttctgttgaacgggatcaatgtgttgatgtttctagttcactgtaactgctaaagggctatgtgtgagacaacggtggtatcatgtgtgtttccttgttactaaactagaatatatgtatcggaaattttgtaatatctggttaactcctatattgctgtatctagtaaatctttcaccag

SEQ ID NO: 2843 - DNA, 6335 bp, Zea mays
taacaacatccaaaaatatgataacatatcaaaataattgattggcaaataatgctgaaactcatcaatacggttattctggtctagtaacaagcaaacataaatgagagcattttctcacagatagcctttcagcagttaccgcgaactagaaacatcaagatatcaaacactgcttcaacagaagatattccagcacaaacaataacaagcacagaaactattaagaatctaatcgacagagctagtacactagatcgtatagcttgtttgcttcagtgatgatccaggaaaatggaatgaatcacgttgtatatcatgaggatatcttgcaaatgtcctcgtattcgacagccctgagaaccttcccatcatagaggcctttctcaacctgcacttttgcacagaatttctcagtgtccactgaaagcaacctggcatttgacccccgataagccccattgacaatccgcacaagtccaccaatctgagggatcacggtctcaagctcatcttggtcgaccctgagaacatgcttgctctccaacatctcaatctccccaacatatttatcaataactttcttcaccacccctttctgcttgtagtaccccttctctgccaatgacttgctcatcactttgaccacaatcccagggcacagccagtagtccttcctattgctcctctccttggccttctcctcctccttcatcagctcgtccaatgctgacctctttgcctctgctgccttcacatcctttcccatcttcttggtcaactcattcttctcctggtctcgggtgcctgagccatcctcctcatcaaaaccaaatttcatcttcggcttatcgtcaaaaggattaaccttgggccccggcacagccttctgaagcgcaatcgcaatcttacctgttgccttatctgcctctttcgagtcatcctccggctcctgctcatcatcatccgaacctgaatactctccttcactgccagactcaggctcgccctcggcagcaccaccaccattgggtttagctaaggacttgtgcgcacgctcaatctggcgggcaatcatgcgctcctggcgctcgtcgtcagccatgtctgacttgatcctcttgcgcttgaggcgttccttgacggcctgctccgagtcacggtcgatgtaggtcatgaaccaccccttgggcgtgtcctcgaccttacagtacccctcgcgccccaggaacttgacgaactcggtgagcgtggcccaccgcgtggagttcatgtggacgtggtgccggtcggcgatgtactcgttgtagacgacggtggcggcgacgcgggagtggcggtgcgcgcggcggatgagggagaggaaggactcgaggaactcctcggagaagccctcgacgacgcggtcgggggccatgccgaacacctgcatctgcctctggtgcgactccgacatgcagtggcacttgaacccgttctcgtcgcggcactgcttctgacacatctgacagtaccaccgcagcttctgcagccccttcgccttgatccggtttgcgatcgccttcggcgtcaggaactcgtgcttccccatcgtgcgggagaggcccttgccgcacaagcaggatgggaattacaggtagaagaaggggggagcacgttggtcaaggagacggacgcgaggcgacgaggagtggattattattgtggagagaggcagcggcggaggccggagaggaggccggcgacggcgagattggggagtgcgtgaacggattggggatcgattggattggggcgagggctttgtttttttttgttgctttttttgtttttttattagacaggcgagggctttgttgggacttgggaataagtccaaggctagcaccacaaatgaacgatccggatcgcgtaaacgatcaatcaacggacgagatccagccaccgtgccagatttttcaacccaacgcatgtgaagggcgcgcatcgtatcttatcttcactctccgtccaccaaagcaaaccctacccgctcccttcccgcgccgccgccgccatggactcgatcgacgcagatctcgcgcgcacgcaagaggagcggcgcaggatggaggaggcgctggcggctggcgcgcccatggccgtgtcctccgtcaccttcgacaccgacctctacggcggcgggggcgccgaccccaaccgcttcgcgggctacgacacctccatcccggcctccgaggacgacgccgcggaggacgacgcggaggccgccaaccctgcgccgcgccgcctcgcggcctacacgggccacgccatcgccgccgccgacatcccgcggtcggccgacgacgacgacgggctgcccaagaggtcccagcgcatcatcgaccgcgaggacgactaccgccgccgccgcctcaaccagatcatctcgccggagcgccatgacccgttcgccgctggggaggccaccccggacccctcggtgcggacctacgctgacgtcatgcgcgacgcggcgctgcagaagaagaaggaggacctgctgagggagattgccaagaagaagaaggaagaggaagagaaggagaaggagaggaaggctgccgctcctgagcagcctgccgccacaacaaagcggcgcaacaggtgggatcagtcgcaggacggcgacgctggtgccggtgccaagaaggtgaagacatcctcggactgggatgcccctgatgcgactcctgggattggccgttgggatgccacccccggacgtgttggagacgccacaccctccgtgagaaggaacagatgggatgagacaccgactccagggaggatggccgatgctgatgctacgcctgcagctggcggtgccacccctggggctactccttctggggcttgggacgcgactccaaagctgcctggtggtgtcacgccaacccctggtaagaagcagagatcaaggtgggatgagacaccagcaagtatggggagtgcaacccctggtagtcttggtgctgcaacacctgctggttatactcctggtccaacgccatttggtgcagagaaccttgccacaccaactcctagccagattgctcgtggaccgatcactccggagcagtaccagctcatgcggtgggagcgggacattgaggagaggaacaggcctctcactgacgaggagcttgatgccatgttcccgcaggagggctacaagattcttgagcccccggcttcctaccagcccatcaggaccccggcaaggaagctccttgcgacaccgacacctctggggacaccactttatgctattccagaggagaatcgtgggcagcattttgatgtgcccaaggagctgcctggtgggttgccactcatgaagcccgaggattaccagtactttggaactttgctgaacgaggaagaggaggagcagctatcgccagaggagcagaaggagaggaaaatcatgaaactgttactcaaagtgaagaatggcacacccccacagcgtaaaacagcacttcggcaactgacagacaaagcccgtgaatttggtgcaggaccgttgttcaacaaaatactgcccttactcatgcagccaacactggaggaccaggagaggcatcttttggtgaaggtcattgacagagtactttataagctcgatgagctggtccgtccttttgtgcacaagattcttgtggttattgaaccactgttgattgatgaggactattatgctcgtgttgaaggcagggagatcatctcaaaccttagcaaagcagctgggcttgctactatgattgctgctatgcgacccgacatcgataacattgatgagtatgtgagaaacaccactgctagggcgttcagtgtggtggcttctgctttgggtatccctgcccttttaccattcttgaaggctgtctgtcagagtaagaagtcttggcaggctaggcacactggtatcaaaatcgtccaacagattgctattctcatgggctgtgctgttttgccacacctcaagtcactagttgagatcattgagcatgggctgagcgatgaaaaccagaaagttcgtacaattactgccctttctcttgctgcacttgctgaggctgctgcaccatatggtatagaaagttttgatactgtattgaaacctctgtggaagggtatcagatctcaccgtgggaaggtccttgctgccttcctaaaggccattggtttcatcatccctcttatggatgctctgtatgctagctactacacaaaggaggtgatgcaggtcctcattagggagttccagtctccagatgaagaaatgaagaaaattgttctcaaggtggtgaaacagtgtgtcagtacagagggtgtggaggctgattatatccggaatgacatccttccagatttcttcaagcacttctgggtgaggagaatggctctagatcgcaggaactataagcagcttgtggaaactacagttgagatggcaaacaaggttggagttgctgatattgttgggagggttgttgaggatctgaaagatgaaagtgagccctacagaagaatggtgatggaaacaatcgagaaggtggtagccaacttgggtgcatcagatattgatgctcgtctggaggagctgcttattgatggtatcttgtatgctttccaagagcagactagtgatgacgcaaatgttatgctaaatggttttggagctgtggttaatgcacttggacagagagttaagccctaccttcctcagatttgtggtactatcaagtggcgattgaacaacaagagtgcaaaagttaggcagcaagctgctgatctgatctccaggatagccatagtaatgaagcagtgccaggaggagcagcttatgggtcacttgggtgttgtgctgtatgagtacttaggagaggagtatcctgaggtgcttggttcaattcttggagccttgaaggctatcgtcaatgtcattggtatgactaaaatgactccaccaatcaaggatcttcttcctcgtctgacccccattcttaagaacaggcatgagaaggtccaagagaactgcattgatcttgttggtaggattgctgatcgtggagcagaatttgtgccagcaagggaatggatgaggatttgttttgagctgctcgaaatgttgaaggctcataagaagggtattaggagagcaactgtgaacacatttggttatatcgcaaaggctatagggccacaggatgtgttggccaccctgttgaataacttgaaggtgcaagaacgacagaaccgggtctgtacaactgtagctattgctatagttgctgaaacttgctcacctttcacagttttacctgcccttatgaatgagtaccgggtcccagagctcaatgtccaaaatggtgttctgaagtcactctctttcctctttgagtatattggtgagatgggcaaagattacatatatgccgtcacccccttacttgaagatgctttaatggatagagatctggttcaccggcagactgctgcatctgctgttaagcacatggctctaggtgttgctggcttgggttgtgaggatgctcttgttcatctgcttaactatgtttggcccaacatatttgagacatctccccacgttataaatgctgtcatggaggcaattgaggggatgagggtcgcactaggtgcggctgtgattttaaattattgcctgcaaggtctcttccatccagcaaggaaagtacgagaagtgtattggaagatatacaactctttgtacatcggcgcgcaggatgcacttgttgcttcttatcctgccctggaagacgatggggataacatctttagtcgtccagagttggcaatgtttgtctgattaacgctggatgtgcatgtccatgtgtcttcatccatattcttatgaagcttgaactggggtacctcatgttgcagctgctgaagcgttacactggatttaggaccaatcctaaggctgcagcatgccaattaatccatcaagatcctatattgtgaaggacaaatgacaatcctagcgcgctgtcatctttttatgaatattaggcgttgggcatttaccgtgttttaaaactttgtattacacatggatgttgtattatgtggtgtggacaatggaacgttgcaagctgacctgaacctgattccttactgtattactgagatgttgatatgcatgtcatgttagtgtacgttgtgttctccttgtcattttgtttgtgatatcgacatgctatgtttgttgctgaagttgagcacaaatgatttgttggtca

SEQ ID NO: 2844 - DNA, 1833 bp, Zea mays
tccaaacaaaggcctcgcccccaaacggccaacccaatcgatcgtccccaatccgttcaggcagtccccgacatcgccatcgccgccgccgctctccatcataaacaatctactcctcgtcgcctcgcgtccgtatacttgaccgcccccttctcctacttgtaattcccctcctgcttgtgtggcaggggcctctcccgcgcgatggggaagcacgagttcctgacgccgaaggcgatcgcgaaccggatcaaggcgaaggggctgcagaagctgcggtggtactgccagatgtgtcagaagcagtgccgcgacgagaacgggttcaagtgccactgcatgtcggagtcgcaccagcggcagatgcaggtgttcggcatggcgcccgaccgcgtcgtcgagggcttctccgaggaattcctcgagtccttcctctccctcatccgccgcgcgcaccgccactcccgcgtcgccgccaccgttgtctacaacgagtacatcgccgaccggcaccacgtccacatgaactctacgcggtgggccacgctcaccgagttcgtcaagctcctggggcgcgaagggtactgcaaggttgaggacacgcccaaggggtggttcatgacctacatcgaccgtgactcggagcaggccgtcaaggaccgcctcaagcgcaagaggatcaagtcagacatggctgaggacgagcgccaggagcgcatgatcgcccgccagattgagcgtgcgcacaagtccttagccaaacctaacgatggtgatgctgccgagggcgagcccgagtctggtggtgaagaagagtattcaggttcggatgatgatggggaggagctggaggatgtctcgaaagaggcaaacaaggcaacagggaagattgcgattgcgcttcagacggctgtgcgagggcctaaggttaatccttttgaagataagccggaggtgaaatttcgtttcgacgaggagggcgacttgggtaccggagaggagaaggatgagctggccaagaagaagggaaaggatgtgaaggcagcagatgcaaggaggtcagcattggacgagctgatgaaggaggaggagatggccaaggagaggagcaataggaaggactactggctgtgccctgggatcgtggtcaaggtgatgagcaagtcattggcagagaaggggtactacaagcagaaaggggtggtaaggaaagttatggataaatatgttggggagatagagatgttggagagcaagcatgttctcagggttgaccaagatgagctcgagaccgtgatccctcagatcggtgggctggtgcggatattgaatggtgcttatcggggatcaaatgccaggttgctctcagtggacactgagaaattctgtgcaaaagtgcaggttgagaaaggtctctatgatgggaaggttcttagggctgtcaaatacgaggacatttgcaagatatcctcatgatatacagtgatccattccattttcctggatcatcaccgaagcaaacaagcactatgcaacccagtgtactagctctgccagttacatatctgatagtgtttgtgcttgttactgcttgtgatggaatatcttctgttgaagcagtgttcaatatgttgttgtttctagttcattgtagctgctgaaaggctatgtgtggggaaacggtgtcatgtatatttgcttgttactagaccctgataattttgcaatatttggttaacttctatatttctgtctctagttaacctttaaccagatttattcttggtagtttgagcattacttttcaatcagttcttttgatcatgttgtcat

SEQ ID NO: 2845 - DNA, 3544 bp, Panicum virgatum
cgaacgagcgcctctccccatcgagtactcctcccccatcccgaaccctcgcaacccgcccccatccccgaacccgcgcgccgccgccgcccgccggcagccgcgccccctccctcgcccctctctcagatctgagccgctgccgccggtggagggcagggccgctgcgcgatggggaagcacgagttcctgacgccgaaggcgatcgcgaaccggatcaaggccaagggcctgcagaagctgcggtggtactgccagatgtgccagaagcagtgccgcgacgagaacgggttcaagtgccactgcatgtcggagtcgcaccagcggcagatgcaggtgttcggcatggcgcccgagcgcgtcgtggagggcttctccgaggagttcctcgagttgttcctcgccctgatccgccgcgcgcaccgccactcccgcgtcgccgccaccgtcgtctacaacgagtacatcgccgaccggcaccacgtccacatgaactccaccaggtgggccacgctcaccgagttcgtcaagttcctgggacgcgagggctactgcaaggtcgaggatacgcccaaggggtggttcatgacctacatcgaccgtgactcggagcaggccgtcaaggcgcgcctcaagcgcaagaggatcaagtcagacatggctgaggacgagcgccaggagcgcatgatcgcccgccagattgagcgtgcacagaagtccctagccaaagccaatgatggcgatgatggtaatgttgccgagggcgaatctgagtctgagtacgacagtgaagaagagtattcaggttcagatgatggtggagagaaattggaggatggctcaaaagaggccaacaaggcaaccgggaagattgcgattgctcttcagaagtctgcaccagggccgaaggttaatcctttcgaggataagccaaaggtgaattttggtttcgatgaagaggactctggtgtccgagagaaggagaaggatgaggtggccaataagaaggggaaggatgtgaaagcagcagagccaagaaggtcagcattggatgagctgatgaaggaggaggagaaggccaaggagaagagcaacagaaaggactactggctgtgtcccgggattgtggtcaaggtgatgagtaaatcattggcaccgaggggttactacaagcagaaaggggtggtgaagaaagtgatcgataaatatgttggggagattgagatgttggagagcaagcatgttctaagagtcgaccaagatgagcttgagactgtgatcccccagattggtgggctggtgcggattgtgaatggggcttatcggggttcaaatgccagattgctctcagtggatacagagaaattctgtgcaaaagtgcaggttgagaaaggcctctatgatgggaaggttctcagggctgttgaatatgaggacatttgcaagatttcctcgtgatatacagtgtttttcatttcatttcctggatcattgcagaagcaaacaagaactatgcgatccagggtactcgcgctgtcagtcgatgcatccgtggttattatgtgtgctggaatatcttctgttgaaggagttcaatatgttgatgtttctagttcactataactgctgaaaggctgtgtgagagaatgttatcgtttggtttgcttcttactagaccagaataactgtattgacaattttgtaatactcagtcagcttctatatttctgtgtctagtgatgaccttttaccagatatttgcttggtattttgagcattacttgccaatcaattcttatgataacatcaaaaaaattcttttgataaggtttgccatatttttcatgatattacgaaggtaaagtattaggttaaaagaaggccacaaaaggaattgtgagtatgttgcggaaagttatttgttgacagctttgcagtttatgcatctctctttggaactgttgcttcatggaagtcgcaaaaaattacatacatatcttattagcaaatttattgatgctttgtttagctatagaagatgaaatatgccaactacaagtctctcacgacataaaattttattggtttgaagaccatcgctttttctttatcccagtttccacttaaaaggagttatgtacctgttaagtatagcaaactaccactgaaactaaactgctgttactctgaaatttggactttgcttttagatagaatgtgtgaattctaatggtagctcaaaagcagcaacgaacatagacagtttttgttaactggctctgtgcagttcttattgtcagctttatttaaacataataaatccaaattcctacaaaacttacatggtctactgtcctgtgtgacaccatttttctttgcctcaattttttagcattctactcaaggaactaatatctggtcgctcaagcttacacatcaaacggtatagtagtcagaattattttgcaagacatcttagttcttctgtttatactatcacaactcacaggaggattcacgaggaacacccaaaggccaaatgtgctagaggtaattgaacttggcgcttccaaggagttccctagctctggactgcggttgatcttccaggaggcgatatgtccatttgcctttttgtgtgaaggagaggttcgaaggcaaggggagcttgtatatcggttatatgtgcttaccgtttctggagttgtgctcttgtgccacttacgcagcccatttttgtacttatctggttcagtactgcatctagatgatatagttgagtttagtctccaaattcatgctcagagtgcaaaggttacggcggtaacagcaaaaccaggatgcattgtaattggtaggcaagatgggtccatctgctcttacagtcttggcaagttagctcctaacacaccaggattctcgaatgagctgcgagatgatgctgggattgggcgtttatggactctcatgtctagaagcaaaactgtgggtcctgtgcaggatatagcggcaactgtcataaatgaaagggacctgttatttgtgggtaaacctacttaattaaaaaatggttacaagctaattctgttgtctgtcacttgaggatggagagagcaagtctttgcttgccattgaaattttcgaaaagcttcatactgaaactccaactgaatatatgaccattgctttttactatttgccacatcgttttgtttcgttgtcatttccagttccatattccaaatatatcttccatggactggattctatctattttgatcccaagataaagtttggaagtgaacattaccattacctttaacttgaaatccacacagagtaaacggttatcaattaattgaattaccaccgctccacataatgcatttatattgtatgaagggattgcgtagtgtattgatatattttccagtttttttgccctctcataaataggagcaattcagatgagagcaaaacaaactagatatgtcattctggacttggtgttctattaagtaatttctactatttttcttcttcc

SEQ ID NO: 2846 - DNA, 1830 bp, Panicum virgatum
cgaacgagcgcctctccccatcgagtactcctccccatcccgaaccctcgcaacccgcccccatccccgaacccgcgcgccgccgccgcccgccggcagccgcgccccctccctcgcccctctctcagatctgagccgctgccgccggtggagggcagggccgcggcgcgatggggaagcacgagttcctgacgccgaaggcgatcgcgaaccggatcaaggccaagggcctgcagaagctgcggtggtactgccagatgtgccagaagcagtgccgcgacgagaacgggttcaagtgccactgcatgtcggagtcgcaccagcggcagatgcaggtgttcggcatggcgcccgagcgcgtcgtggagggcttctccgaggagttcctcgagttgttcctcgccctgatccgccgcgcgcaccgccactcccgcgtcgccgccaccgtcgtctacaacgagtacatcgccgaccggcaccacgtccacatgaactccaccaggtgggccacgctcaccgagttcgtcaagttcctgggacgcgagggctactgcaaggtcgaggatacgcccaaggggtggttcatgacctacatcgaccgtgactcggagcaggccgtcaaggcgcgcctcaagcgcaagaggatcaagtcagacatggctgaggacgagcgccaggagcgcatgatcgcccgccagattgagcgtgcacagaagtccctagccaaagccaatgatggcgatgatggtaatgttgccgagggcgaatctgagtctgagtacgacagtgaagaagagtattcagattcagacgatggtggagagaaacgggagaatggctcaaaagaggccaacaaagcaaccgggaaagattgtgattgctcttcagaagtctgcaccagggctgaaggttaatcctttcgaggataagccaaagttgaattttggtttcgatgaagaggactctagtgtccgagagaaggagaaggatgaggtggccaataagaaggggaaggatgtgaaagcagcagagccaagaaggtcagcattggatgagctgatgaaggaggaggagaaggccaaggagaagagcaacagaaaggactactggctgtgtcccgggattgtggtcaaggtgatgagtaaatcattggcacagaagggttactacaagcagaaaggggtggtgaagaaagtgatcgataaatatgttggggagattgagatgttggagagcaagcatgttctaagagtcgaccaagatgagcttgagactgtgatcccccagattggtgggctggtgcggattgtgaatggggcttatcggggttcaaatgccagattgctctcagtggatacagagaaattctgtgcaaaagtgcaggttgagaaaggcctctatgatgggaaggttctcagggctgttgaatatgaggacatttgcaagatttcctcgtgatatacagtgtttttcatttcatttcctggatcattgcagaagcaaacaagaactatgcgatccagggtactcgcgctgtcagtcgatgcatccgtggttgttattatgtgtgctggaatatcttctgttgaaggagttcaatatgttgatgtttctagttcactataactgctgaaaggctgtgtgagagaatgttatcgtttggtttgcttcttactagaccagaataactgtattgacaattttgtaatactcagtcagcttctatatttctgtgtctagtgatgaccttttaccagatatttgcttggtattttgagcattacttgccaatcaattcttatgataacatcaaaaaaattcttttgatag

SEQ ID NO: 2847 - DNA, 1994 bp, Oryza sativa
cggagcgagtagactttctgaatgatgggttgggggcccaggtcggtcgccctgactgacctggctcagggccggcccgagatctccccgtcagaccccggccaaaccctagccaccgagccgagcaagaggagagaagggccgccgcctcccccgccatccgcgtggccgccttccccaaccgcagcgctctgaaacacaaacttccccaatccccaatccccaatcccccaatctaccccagctttctcccgataattctctcctccgatttcgccgccttccctcccgctcgggccatcgacgcagcctcccctaaagaacaacacctaccctctgccgcgtcggcgaagagatggggaagcacgagttcctgacgccgaaggcgatcgcgaacaggatcaaggcgaaggggctgcagaagctgcggtggtactgccagatgtgccagaagcagtgccgcgacgagaatggcttcaagtgccactgcatgtcggagtcgcaccagcgccagatgcaggtgttcggccaggcccccgaccgagtcgtcgagggcttctccgaggagttcctcgacgccttcctcaccttgctccgccgcgcccaccgccactcccgcatcgccgccaccgtcgtctacaacgagttcatcgccgaccgccaccacgtccacatgaactccacgcgctgggccacgctcaccgagttcgtcaagttcctcgggcgcgagggccactgcaaggttgaggacactcccaaagggtggttcatcacctacatcgaccgcgactccgagcaggccgtgaaggccaggctcaagcgcaagaggatcaagtccgaccttgcggaggacgagcggcaggagcgcatgattgcacgccagatagagcgagcccagcaatccatgggtaaaactaatggtgaacttggtgatgatgctagtccggatggtagcgaaggtgagtccggcagcgaagatgagtattcggactcagaaaatgaccatgagggacaagaggaggatgcaaaagaagccaacaaagcagcagggaagattgcaattgcacttcagcgggctgtgccagggccaaaggttaaccctctcgatgataagccaaaggttaaatttggttttgaggaagaggatgaggtgagcgcgcgggataaggagaaggaagagttggccaagaagaagggaaaggatgctataaacgcagcagaagctaggaggtcagcattggatgagctgatgaaggaggaggagaaagcgaaggagcggagcaataggaaggattactggctatgcccaggtattgtggtcaaggtgatgagcaagtcgctggcagagaaggggtactgcaaacagaagggtgtggtgaagagggtgattgataagtatgttggggagattgagatgctggagagcaagcatgttcttagggtcgaccaagatgagcttgagacagttatcccccagattggtgggctggtgcgtattgttaatggagcttaccggggatctaatgcaaggttgctttcagtggacacagagagattttgtgccaaagtgcaggttgagaagggcctctatgatgggaaggttcttaaggccattgagtacgaggacatttgcaagatttttcactgagatatcatggaattccatcttatttctggagcattactgctgtcaaatgtcaaacatatgactatgcaagccaatgtgttggacctttctgttagttgcctgacaatgtatgtgcttgtgctagaatttgttctatcgaatatctttcacatgttgatgtttctactttctagttcttcctagctgccgaaagaactctgtgtaagaaaatggtctgatgctttcttgcttgtttggtgattagaatgatatgacaatttttcaacatgtaatctctccataattgtttctgataaaacttgttagttaccaaataaaatttactcagccagttcctttttttttt

SEQ ID NO: 2848 - DNA, 1753 bp, Brachypodium distachyon
ctgtctcgtcgtcctcgacacattttcaaataagccctccgaattccagtgcctccaaatcaactccccgatccaatccccaatccaccagactagccttccctgatccctccggcgccgccgccgctcgccggcccgtacccgcgcctcttctcgccgcccctccacccagccccttcacaaagctcctcctcttcgcatcccagcggcagaaggcagcggcggcggtatggggaagagcgacttcctgacgccgaaggcgatcgcgaaccggatcaaggccaagggtctgcagaagctgcggtggtactgccagatgtgccagaagcagtgccgcgacgagaacggcttcaagtgccactgcatgtcggagtcgcaccagcggcagatggccatcttcggccaggcccccgaccgcgtcgtcgagggcttctccgacgagttcctcgaggagttcctcaccctgctccgccgcgcccaccgcagctcccgcgtcgccgccaccgtcgtctacaacgagttcatcgccgaccgccaccacgtgcacatgaactccacccgctgggccacgctcaccgagttcgtcaagttccttggccgcgagggccacgccaaggtcgaggagacgcccaagggctggttcctcacctacatcgacagggactccgagcaggccatcaaggacaggctcaagcgcaagagggtcaagtccgacctcgccgaggacgagcggcaggagctcatgattgcccggcagattgagcgcgcccagcaatccatgtccaaggctaatggcgatgaagatgatgcggatgccgagggtgtcacgggtagtgaagatgagtattcaggatcagacgatgatcaagaagaaccggaggaggaggatgtgaaggaggccaacaagacaacaaggaagattgcaattgcactccagcgggctgcaccaccgcctaaggttaaccctttcgacgataagccaaagatgaaatttggcttcgaggaagaggaggaggtggtcaataagaaggggaaagatgctgggaaagcagcagaaccgaggaggtcagccattgaagacctgatgaaggaggaggagaatgctaaggagcggagcaaccggaaggactactggctgtgccctggcatcgttgtcaaggtaatgagtaaatctctggctgagaaggggtactacaagcagaaggggctggtgaagagggtgatcgataagtatgttggggagattgagatgctagagagcaagcatgttctcagggtcgaccaagatgaacttgagaccgtgatcccacagattggtgggctggtgcggattgtgaatggggcttaccgggggtcgaatgcaaggttgctcgcagtggacacagagagattctgtgccaaattgcaggttgagaagggcctatatgatgggaaagttctcagggccattgagtatgaagacatttgcaaggttgcttagtgagatatcatggaatttcatttttcaattccagcacttctttttgctgtaaaatggagttacagacccaatgtactagctctgtctgttagttgtgtgatagtgtatgtgcatttgtgcttgtgctagaatatcacctattgaagaagtttgaaatcttgatgtttctagttcactcttgctgctgaaagcacattgctcaacttgttcgtatttgttccgagtcaatcttgttaccagtttaatttttggtagcttgttactttgttgcat

SEQ ID NO: 2849 - DNA, 5179 bp, Oryza sativa
ctacgagtcggactatgtttgtccgggtcggagttgagttccggctcgagatagcagcggagaccgtcggattttgatcgcacggtctgcggctccgtgtcggcctcgctggggttcagcgctgcgacgccatgtccgagacggattcatcggcggcggcggcggagggtcggaagccgaggcggctgcgggggcacaagaagggcgccgtcacctgctgcgtcgcctcctcctcccgcccgggcgtcgtcgcctcctccggcgaggatggatgtctttgctggtttgatttgcgtacgaaggatgtgcttttcaccatggaggcgacaaatcaaccaatttcttctgtgtgtttcaaagcaggaaatgaagatcttgtgtatgcctctgctggaaatgaaattttatctttcgatgttcgaatgggacctcaagcaaagccattggacacttataactacaatagagatgaaatcaatcagattgctgtgagctctaaaggttttcttgctgctgcagatgacagtggggatgtcaagattatcaacaccatccaaaaaagcctgtacaaaagattgagggaagcccacacaagtatttgcagcagtgtacaattcattccttggagaccttggacagctattactggaggccttgattcaaagcttgctgtgtgggatttctccaaagggcgaacactgttttctatagattatggatcacctgaaatgcagaatggaagttcaggtgggcaatgtttcaatcctccttttgttcactcaatagcagtttctgaagagggcatcttgggagggtcgtacaaagtttgtgctgttgcaagaggagatggtgctgttgatgtggttgatctagaatatgaacttgcccctgcaaaatcaaaagggcttcctcggatggcagatttgagtttaagctcgaaaagaactgatttaggagatggatgtggtagtcaaagtcaagggaacaggatccaccttgattacacagtgggtggtcatacttcatctgtttcttgcgttacattttcagcatttggcgagaaggggaagtttcttgtttctggtggcaatgattcatcaattaaattatgggattggtccaaagggttctcctctgaaacaaacaacagtgctgaattggtgttggatataaaggttaataaaaaggtgaactggttgtgtactactccgactgattcagataacctgattgtgtgtgacacatccaaggtggtcaaagtttacaatctaccttagactgacaatgtgcggcattatcaatgcccaagagcagccctgtaccagtcgatgggacaatttcttgaggacatttagcacaaaattgtgtgcccgaccatcagtgtcagcttggtcctgactagtcttttgacaatgatgaagctaggcccactgcagcaagttgtgtgacgtgagaaatcaagattgttagttctctgcagctagttgtgtgaagtgagagttcaagattgttaatacggtgaaatgaacgtatgttctctaagagtcagcgtgtttttgtgcttgcaaccagcttccttgtactaatggcgaaatccatttatgttttgtgttattttagctgttctttcttacaaagacaataccacaatgatgtagcgcatcatcttcaattcttcctcatgtaatgtaacgagtaaatcatagtcaatattcaagcttacatggtgctatatgtagcacatatgtacgctactatgaacaaaactatgcctgagtaatgaaacatgtttttttttttttttttttgctcaccaataacctctgcaagaacacctaccttcttcaaaatggtgaaatctatttgaatccctcaaaattatctctctaccacacatcttggagatgaacttggcagcctcatggcaatggctgcaaactcttgaattcttggtcacacggattggccgcccttgtgacagattcagaacaccgaatgccacggcgagctttgaactatgcccacagagcgcctcatcatgaacagcatcgtcagcgcccatcagagcatattttttcttaggatcatggccttcttcctgcatcctcctggcaacatcatccaggaactctgcaatcctcattccttgtggatgatttcggttttccgcgaagaagatatgggcctttcctctcacttcaatccagctgcagccagtgttctcacggagcccacggccaccaaccttgttcttgagcttcctgacagcctcccatctctcagcttcagcatagatgttggcaagaagaacatagtaccctgtgttctcaggttccagctcaaagaccatctctgctaccttctctgcaagcttgacattcctgtgaattcgacatccacgaagcaatgagacccagatgctcgaatccggttcgatcggcattgtctctatgaactcataagcttccttcagattcccagtgtggcatagtagatcgaccatgcaggcgtagtgcttcagtttaggctctattctgtgctcattccgcattgcattgaagaatctccatccctcatctcttaggcctgaatggctacaagcatacagaatggcactgaaagaaccggcatcaggctgaatgccacttcccttcatctgctcaaagagggcaatggcatctctaccgcgaccatgcatgccatatccagctatcatgatggtccatgagataaggttcttgttggttaacatgtcaaacaaacggcgtgctagcagtaatgcaccacatttaacatacatgtcgacgagtgcattggctacaaaattatcttccaagtaccctctccgtactgcgtaggcatgcatctccctgcctcgctccagcgatgaaaggcttgctgcagctggaaggatgcaggccatggttaccgcattaggtcggagttggagtagcatttcattgaataaggtgaaggcttcattggcaagattgctcctggagtaacctcctattagtgtattccatgagattgtatccttttttgtcacatgatcgaaaataaatcttgcctcttccatatacccacatttcacatacatttccatcagtgcattagcaactggaagaacttcctcaattccatttctgatggcatatccatggacagatttcccatgtttcagtgattcgttgccagcaaatgcatcaagagcactggtgattgcgaagacatctggtctgataccttctaatcccatttcctgaaataacccagccactttgtcaaaatgcccagccctggtataacttgtgatcattgctgtccatgacaccacatttttctgttccatattcctgaatatcttattagtgctacgccaatctgagcaatttgaatacatatcaagaagagcattaccaagagatgtctcactaatcaatccagttctcacagaatacccatgaaccactcctcctataaatgaatagtgcgactgtacacaagccggcataacacttagcagtgtagtagagtccagctcctgtccttctaaccacattcttacaaacaactcaacagctttatcatatagaccattggaagcacatccaccaattatagaattccaagaaatgatgtcacgttgaggcatttcatcaaacaccatgagtgcgtcttcaatcctgttggattttgcatagaatgatatcagtgcattgcaaactgcacactgtgccccaaaaccgtacttcacaagatacccatgaaccaccaaaccatccattacaccagacaaaccagtgatacactttaggaggcaagaaatggtatgctcatcaggagtaattccacagtcatgcattttctcaaacagcaagaggctttcttgaaatttaccaagcttcgcatacccacccatcattagattccatgcatgtaaattgcttttcgatgacattgcatcaaaaaccttccttgcatagcccaattcaccacatttaacatacatgaacaccagtttggatcccagattttcatctatcccattctccaaagattcaaattcccaaagtagtccggttttaactgagtatccatgaagcacccttccgacaagattgtatcctaattcagcacaagcaggcaaaacgccaagcatcgtcactggattgatctcgaggccttcagaccacattttggcgaaaagctcaatagacttaccatgccatccattcgaaaagcacccgctaatcacagaattccaagaaatgacatcccggtgaggcatcccatcaaacacctgtagtgaaccatcaacatggccacacctagagtacagtgctataagcgcatttccaaccgcacattgcacccccaaacccaacttctcaaggtacccatgaactacttcaccatctgcaatactgcccaaaccggcaatgcatttcaagacacacgaaatagcatgtgcatccggcctaaccccagaacagtgcatctgcctaaacagcaaaacgccgtcttggaactcaccagctttcgcgtaaccgctcatcagtgaagtccaaactcgcacgtcactcacttgaggcatttcatcaaacaccttccttgcattctccaaatccccacatttcacatacatcagcaccaatttccttccgagaacactatccattccatcttttccaacaccagatgcgcgaaccaagaaatgggctctcttcccggcctccaaagatctcagatccgagcagagctggacgaccgcgccgtagctccgggcgtcgacgccatccgagccgagcaacctcaacgcctcctctaactcacccgcccgacagagcctctcaatctgcacgtccacatcggttctcggtgcccgactccgcgaattcttggcgcccctcggagcagaggccgcctccaggatatgaccggacgccgcgaggacgtcgcacctaacccttgttcttgggctgctgttcttgggaggcggccatggaggaggggctcggaggtggctggaaacggaggtgagtggaggcgtcgccatgggagcaggaggaagaagaagaagaaggggagttcaaattttgccgcgaaatcccgcgatgttgccgcggcttcgcttggttgaaatggatagctttctggattgggttgcaaagtttcc

SEQ ID NO: 2850 - DNA, 2110 bp, Zea mays
atgtcgatctccacgctacgccggtgtcgtccccctcgacggcatcgcccacactacagtaccagcgagcaggtgggcacaaagcgcgcagcattgaaaaggagagccatgcgcgccaacagttccgtgcccacttggcgctttgccaacgctgcggtagcacgcgggccccgtgcgccagtggcagcatcgtcagttagtctcgacccactgacaactcgggtctcacgttacgttgctatatccactatgtactactatatgcactgtcaagtgacaactcgggccgcacggtctccgctcggttctccagtccagtgggcaatggtgccaatggacccctcgatctcctcgtcctcctcgcctctccggctccccggaacccccaccagcccgggcgcgagcccgaggcccaccctcgtcgcggccggccgccagcccgccgccgcgcccagcaccacccgcctccgcgccatctcgccgtcccagtccccgcccaccccggcgtcccccgtggagccgttcggcttcgacgcgctcaaggggaccttctccgtggacgtggcggcggccgacgcgcgctcgctcgacgtcccgctcgccgcgcccttcaccatcgcgtcctcccgcctcgtcgcggtctccaacgtcgccgtgcgcgtcgagctccgcaccggcgctgtcgggtggggggaggcgcccgtgttgccctccgtcacggccgaggaccagccggcagcgctcgacgccgcgggacgggcgtgcgcagcgctcgtcggcgccccagcggcgcccctcggcgcggtgctccaggacctcgccagtgtgcttccgggacacgccttcgcctcggccagagcaggggtggagatggcgctgattgatgctgttgctaatagcattggcatacctctatggagattatttggaggagcatcagatagtttgacaactgacatcacaattccaattgtgaccccaaatgaagctgctcaattggctgcaaaatatcatggacaagggtttcaaactctgaagctcaaggttgggaagaacttgaattcagatatagaagttctgaaagctatacgacttgtccatccagattgctcatttattttggatgcaaatgagggatacacagcaaaacaagcaattgaagttcttgatagactaaatgaaatgggagtgacccctgtgctctttgaacaaccagttcacagagatgattgggacggtctccgagatgttacctctgtggccatggagaaatacaaagtcgctgttgctgctgatgaaagctgtcgaagtttacttgatgctcaaaaaataatagatggaaatcttgcccatgttattaatatcaagctggcaaagttgggggttcttggggcccttgaaataattgatgctgcaagaaaagccaatattgctctgatgatcggtggcatggttgagactaggatcgctatgggcttcgctggtcacttagctgctggccttggttgctttagtttcattgacctggacacacctcttttactgtctgaagatcctgtatatggtggctatgaagctttcggacctctgtacaagtttacaaatgctcgtggccatggcggtttccttcacttggacaatgaagcctcgaaatgaagatgaaatacaagtgatagaagtgagcttcatcgaagcattgctgtgcattccgtaatgcactgttccactggacaatcatcacataaccggaatcacacaagcgatcgcaagcatatagccatataggaccatttagtcagcctgtagatagacattcagaaggctgttgcaagtccagtcaggcctggagcactggactatttggtcagcctgtagatatagatattcagaaggctgttcccgctggctctgttgttttatccagacattctatgcaataaatacatctggttgtaaatgtcaacacatgcagccctgagccgtcgtaagcctttgttgttctatagctgttcagtataattaaggctttccttaattacgctgaagcgaacgtatgtaggagcaaatttaacaatagagccaactattggctgcaagattcttataatat

SEQ ID NO: 2851 - DNA, 1832 bp, Setaria italica
ctcgcccgtcctcgcctcccttcgccgcttccccgggaatctcgccggcccggcttccggtctccgcttctccactctccagtactagcggccatggacccctccatctcctccgcgtcctcgcctctcctcaggctccacggcaccccgggcgccgcgaacgccagcccgcggcccagcctcgtggcggccgcccgccagccggcctcctccgcgacgcccctccgcgccgtctcgccgtccccgtcgccatcccgccctgcccccgcgtcccccgccgcggagccgttcggcttcgacgcgctcaaggagaccttctccgtggacgtggcggcggccgaggcgcgcccgctcgccgtgcccctcgcggcccccttcaccatcgcgtcctcgcgcctcgacgccgtctccaacgtcgccgtccgcgtcgagctccgcagcggcgccgtcgggtggggggaggcgcccgtgctgccgtccgtcaccgccgaggaccagccggccgcgctcgccgccgcggggcgggcgtgcggcgcgctcgaggccgcgcccgcggcgccgctcggcgcgctgctgcaggacgttgcgggtgtcctccccggacacgacttcgcatcggctagagcaggagtggagatggcactgattgacgcggtcgctaacagcattcgcatccctctgtggaggttatttggaggggcatcagatactgtgaccacagacataacgattccaatcgtggccccaaatgaagctgctcaattggctgcaaaatatcgagggcaagggtttcaaacactgaagctcaaggttgggaaaaacttgaactcagatatagaagttctgaaggctatacggctcgtccatccagactgctcatttatcttggatgcgaatgagggatacacagctgatcaagcaattgaagttcttgatagactaaacgaaatgggtgtgactcctgtactctttgagcaaccagttcacagagatgattgggaaggtctccgagatgttagtattgttgccatggagaaatacaaagtcgctgttgctgctgatgaaagttgtcggagtttgcttgatgctcagaaaataataaatgggaatctggcccatgttattaacatcaagctagcaaaattaggggttcttggagcccttgaaataattgacgctgcaagaaaagccaatgtcgctttgatgattggcggtatggtggagactagaatcgctatgggctttgctggtcacctagctgctgggcttggttgtttcagttttgttgatctggacacaccccttttactgtcggaagatccagtgtatggcggctatgaagcctttggacctctgtacaagtttacaaacgcccgtggccatggtggtttccttcacttggacaacgatgggtcgaaatgaagatggttaacaacggatttgtcagtcctggagcttcatcgaagcattgcagctcatgacataactgcattgttccattggatgaccatcgttgtaattgaaatcaaaggagcagtagcaaagcatgtagccttcagtttgctgctgttgcaagtccggtcagggctataagcctgtaacatttgatcaggatgtagatagtatatttataaggctgtttcagctggcattgttgttatcaaaatattccagtaactgctatgcaataaatatacctggttgtaaatattacatgcagccctgttaagcttttgttgttctatagcttttcagcttgagtaaggtgtgctttttcaaaaggaaaaaaaaaaggtttgtcttgattgtgctgaacgtatggaagagttgca

SEQ ID NO: 2852 - DNA, 1973 bp, Brachypodium distachyon
gcccttcttgtcagttgtcattgctcccaaccactctatatagaggagcagagcagcagctcgtcttcctccggccggcatccccaccaatctccgcatcctccaccgagttccccactccccagtgtcggtcgcaatggacacctccgtctcctcctcctcctcctcgccgcttctccggctttctcgaaactccaccagcccgagatcgaccgtcaacccgggtcctcgcgtggccccggcccgcggcggcggccgccagctccccgccgtcacccgcctccgcgccatctcaccgtctccatctccgacgccgccgatggagaccttcggcttcgaggctctcaaggagaccttctccgtggacgtgtccgcggcggaggcgcgcccgctcgacgtgccgctggcggcgcccttcaccatcgcgtcctcgcgcctggagtccgtctccaacgtcgccgtgcgcgtcgagctctccagcggcgccgtcggctggggcgaggcccccgtcctgccctccgtcaccgccgaggaccagcccgccgcgcttgccgccgtcggccgcgcctgcgccaagctcgccggcgcccccagcgcgcccctcggcgccgtgctcgaggacgtcgccgccgcgctccctggacacgccttcgcctcggccagagcaggagtggagatggcagtgattgatgcagttgctaatagcatccgcgtacctctgtggagattatttggaggagcatcaaatagcgtgacaactgacatcacgattccaatcgtgacaccaaatgaagctgctcaattggctgcaaaatatcgaggacaggggtttcaaactctaaagctcaaagtagggaaaaacttgaactcagatatagaagttctgaaggctatacgtcttgtccatcctgattgctcatttattttggatgcaaatgaagggtatacagcaaatcaagccattgaagttcttgacagactaaacgaaatgggagtgactcctgtactctttgagcaaccagttcatagagatgattgggaaggcctccgtgatgttagcactgctgccatggagaaatacagagttgctgttgctgctgatgaaagttgtcggggtttacttgatgctcagaaaataataaatggaaatctttctcatgttattaacatcaaactggcaaagttaggggttcttggagccctcgaagtaattgatgctgcgagaaaggctggtattgcactgatgattggtggtatggtcgagactaggattgccatgggctttgctggtcatctagctgctgggcttggttgtttcagttttattgacctggacacacctcttttgttgtctgaagatccagtttacggtggctatgaagcttctggacctctctacaagttcacgaatgcccgaggtcatggtggtttccttcacttggacaataacaatggatcaaaatgaagaatggttaaggcacgcctctgctcttccggaacttcataaagcatatcaacacacgcagtgtaaaattatgacattcgaagacttgtcaggtggaactgaaatcaaacaagcaactgtgactccgtggcatgaaaagttccatctatgatctatgtaatgttgcaagtccagtgaggccttgagtatttatgatcaggctgtagatagatgttcagaaggcctcctctagtttggctggcattgttgttgtatcaaaacaaaatagtgcagtaactgctccacagatgtataagtaccgcgaaagcagaccttcataagctacaaagagtctgttctccttgtattcgcgtcagtcttaataatgttttcacgatgaactgtgcttcacttcgctgtgggtttaggatagcttggctttgaagtggtatactgtttgggattatacatccgctctttggccaattgagctaggcctcttcctacataaaaagtatgcatggaaatg

SEQ ID NO: 2853 - DNA, 1928 bp, Triticum aestivum
atcgctcgtcaacgtcgtccgagccaccgcttcccagcgctgccggccatggacgcctccaccacatcctcctcatcccctctctgcttcgcccagaagcctcccagcccgaggcccctcctcaaccccacccctcgagccacccacgccggcgccggccgccagagagccacccgcctccgcggcatctcgccgtcgccgtcgccgtccccaccgaccccgcagcagcagcagcagcagccaatggaggcgttcggcttcgacgcgctcaaggagaccttctcggtggacgtggcggcggccgaggcccgcccgctcaacgtgccgctcgccgcgcccttcaccatcgcctcctcgcgcctcgacgccgtctccaacgtcgccgtgcgggtcgagctctccagcggcgccgtcggctggggcgaggcccccgtgctcccctccgtcaccgccgaggaccagcccgccgcgctcgccgccgttggacgcgcctgcgccgcgctcgtggccgaacggagcgcgcccctcggcgccgtgctccaggacgtcgccgatgcgctccccggacacgccttcgcatcggccagagcaggagtggagatggcagtgattgacgcggtagctaacagcatccgcatacccttgtggagattatttgggggagcatcaaacaccgtgacaacagacatcacaattccaattgtgaccccaaatgaagctgctcaattggctgcaaaatatcgaggacaagggtttcaaactctgaagctcaaagtagggaaaaacttgaactcggacatagaagttctgaaggctatacggctagtccatccggactgctcatttatcttggatgcaaatgaagggtacacagcaaaccaagcaattgaagttcttgacagactgaacgaaatgggagtgactcctgtactctttgagcaaccagttcatagagatgactgggaaggtctccgtgatgttagcattgctgctatggagaaatacagagttgctgttgctgctgatgaaagctgtcgtggtttacatgatgctcagaaaattatacatggaaatcttgctcatgttattaacatcaaactggcaaagttgggggttcttggagccctcgaagtaattgatgctgcaagaaaagctggtattgcacttatgatcggtggtatggtcgagactaggattgccatgggctttgctggtcatctggccgctgggcttggttgtttcagttttattgacctggacacacctcttttattgtctgaagatccagtgtacggtggctatgaagcttctggacctgtctacaagtttaagaatgctcgaggccatggcggtttccttcatttggacaacaacaatggatggaaatgaagatggttaacgcccgccttatcctcctggaggaactttataaagcatatcagctcattcagtatagagtgtagaagttatcacacccgacgacaatcatgtggaactgaaatgtaacacaatcaattgtaagccatatatagcggtaaagctcctgtttatgtactgctgtaagtcctgtgaggcctatgatatttgatcaggctgtagatagatacgttcagaaggccagctcggctggcattgttgctgtagtgtagtacaagcagtaactgttccctcagtgttctcctttgtatttttctggaataaatgagactgccctttgagctagcaaagtttactgtgcatttccatgtttctgaggcgtctatcgtcgaattctgcggcatttgtgcatcagtgaaagagaagattttgtggacgaggctacgagcatctcgtttcgaagggtgagaggggattaatagctccggctgaagatcagaccatgtgatttctatatatgaaatcggagagggaggcctctattttgaccc

SEQ ID NO: 2854 - DNA, 1778 bp, Secale cereale
ccacatcctcctcaccccctctccgcttcgcccacaagcgtcccagcgcgagcccacgcctcagccccgccccacgattcaccccagccggcgccggccgcctccgcgccatctcgccgtcgccgacgccgtccccagcgacgccgcagcagcagcagccgatggaggcgttcggcttcgacgcgctcaaggagaccttctcggtggacgtggcggcggcggaggcgcgcccgctcaacgtgccgctcgccgcgcccttcaccatcgcctcctcgcggctcgaggccgtcgccaacgtcgccgtgcgggtcgagctctccagcggcgccgtcggctggggcgaggccccggtctcccctccgtcaccgccgaggaccagcccgccgcgctcgccgccgccggacgcgcctgcgccgcgctcgtggccgcccggagcgcgcccctcggcgccgtgctccaggacgtcgccgatgcgctccccggacacgccttcgcatcggccagagcaggagtggagatggcagtgattgacgcggtagctaacagcatccgcatacccttgtggagattatttgggggagcatcaaacactgtgacaacagacatcacgattccaattgtgaccccaaatgaagccgctcaattggctgcaaaatatcggggacaagggtttcaaactctgaagctcaaagtagggaaaaacttgaactcagacatagaagttctgaaggctatacggcttgtgcatcccgactgctcatttatcttggatgcaaatgaagggtacacagcaaaccaagcaattgaagttcttgacagactaaacgaaatgggagtgactcctgtactctttgagcaaccagttcatagggatgactggcaaggtctccgtgatgttagcgttgctgctatggagaaatacagagttgctgttgctgctgatgaaagctgtcgtggtttacatgatgctcagaaaattataaatggaaaccttgctcatgttattaacatcaaactggcaaagttgggggttcttggagccctagaagtaattgatgctgcacgaaaagctggtattgcacttatgattggtggtatggtcgagactaggattgccatgggctttgctggtcatctcgccgctgggcttggttgtttcagttttattgacctggacacccctcttttattgtccgaagatccagtgtacggtggctatgaagcttctggacctgtctacaagtttaagaatgctcgaggccatggcggtttccttcatttggacaataacaatggatggaaatgaagatggttaacgcccgccttatcctccgggaggaactttataaagcatatcagggcattcagtatagagtgtacaaggtatcacacccgacgacaatcatgtggagctgaaatgtaaaacaatcaattgtaagctatatatagtggtgaaattcccgtttatgtactgctgtaagccctgtgaggcctataatatttgatcaggctgtagatagacaccttcagaaggccagcttggctggcattgttgctgtagtgtagtacaaccagtaactgttctcctttgtattttcctggaataaatgagactgccctttgaggtagtagccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 2855 - DNA, 2191 bp, Oryza sativa
ggcccagtagcagtgacggggacagatcacgtgggcccacatgtcagtgtaccatgtcaaacctgcgcaccaactcctactctataaaggaaaaactcgtggtcgtcttcctcctcgagccattccacaaaattcggcaaaatccagtgctccagtcagtggcagtggcagtggccatggactccgccatctccacctcctcgtccttctcgcctctcaggttgtctcagaatcatgggagcatcatgagcggtagcaccagggctcaggtgctcccggtgggcaggcagcagcagcagccacccgccggcggcgccacccgcctccgcgccgtctcgccgtcgccgtcgccgacaccgcccgcgccgcagccggcggagacgttcgggttcgatgccctcaaggaggccttctccgtcgacgtggtggcggccgaggcgcggccgctcaacgtgcccctggccgcgcccttcaccatcgcgtcgtcgcggctggacgccgtgtccaacgttgccgtccgggtggagctccggagcggcgcggtcgggtggggggaggcgcccgtgctcccctccgtcaccgccgaggaccagcccggcgcgctcgccgcggccacccgggcgtgcggcgctctggccggcgcgcccgccgcgcccctcggcgccgtgctccaggacgtcgccagtgccctcccgggacacgacttcgcctcggctagagcaggagtggagatggctttgattgatgcaattgctaacagtatccgcatccctttgtggagattatttggaggggcgtcagacagtgtcacaacagatatcacgattccaatcgtgacaccaaatgaagctgctcagttagccgcaaaatatcgaggacagggatttcagactctgaagctcaaagtcgggaagaacttaaactcagatatagaagttttgaaggctatacggcttgcccatccagattgttcatttatcttggatgcaaatgaaggatacacagctaatcaagcaattgaagctcttgatagactaaacgaaatgggagtgactccagtattgtttgagcaaccagttcatcgagatgactgggaaggtctccgcgatgttagcattgttgccaaggagaaatacagagttgctgttgcagctgatgaaagttgtcgtagtttgcttgatgctcagaaaataatggatggaaatcttgctcatgttattaacatcaagctagcaaagctagggattcttggagcccttgaagtaattgatgctgcaagaaaagcccgcattgcgctgatgataggcggtatggttgagactaggatcgctatgggctttgctggtcatcttgcagctggtcttggttgtttcagttttgttgacctggacacacctcttttactgtctgaagatccagtgttcggtggctatgaagtttctggacctgtatacaagtttacaaatgctcgaggccatggtggtttccttcacttagacaacaacggcttgaaataaggaatgccctagccctttgggagcttcacagacaacggtgacacgttcaatgaacaattaattgttcattatttaccttcaacaataatcaattggagttgaaaccaaaggagcagttgtaaacttgtaatcctatatgaccttgaagaggctaattattgttgccagtccagttaggcctgaaatatttgatcagtctgtagatggataaaataatgaggcattttcagctggccttgttgttctgttcgataaataaattactaaatatggtataaaagaccttatgtatgcagcctcaaatatgctcaagtacaatgtattatgcttacttttggtgttacctgcttcagtgctactcatacttgacaagttgctgccgccgcctagctcccttgccaccgtcgccctgctgccgctcgtcgccgtgcgcccccctgctgccgtcaagaagacatgggaggagagagtggtaaagaaggaagagaccgaggagagtatgacaagtgggcctcactttattttttttaattttttttatgactgagatgacacatgggcatcacgttagcgaattggacagtcaaaatatccggtattgtgattgacagatacgaatcagatgagacctataatttaaggtactaagagtggacttattttccacaattgac

SEQ ID NO: 2856 - DNA, 1850 bp, Hordeum vulgare
ctgcagctcgatcctccatcggccggcctcccgcgaatctccatcgctcgtcaacgtcccaccgctgccggccatggacggctccatctccacctccatctcctcctcccgctcctccccactccgcttctcccacaaccctcccaccccaaggcccctcctcagccccaccccacgactcacccctgccagcgccggccgccagccatccgcccgcctccgcgccatctcgccgtcgccgtcgccgtcccccacgaccccgcagcagcggcagcaggagccgatggaggccttcggcttcgacgcgctcaaggagaccttctcggtggacgtggcggcggccgaggcgcgcccgctcaacgtgccgctcgccgcgcccttcaccatcgcctcctcgcgcctcgaggccgtctccaacgtcgccgtgcgggtcgagctctccagcggcgccgtcggctggggcgaggcccccgtgctcccctccgtcaccgccgaggaccagcccgccgcgctcgccgccgtcgcccgcgcctgcgaactgctcgtggccgcgcggagcgcgcccctcggcgcggtgctccaggacgtcgccgacgcgctccccggacacgccttcgcatcggccagggcaggagtggagatggcagttattgacgcggtagctaacagcatccgcatacccttgtggagattatttgggggagcatcaaacaccgtgacaacagacatcacgattccaatcgtgaccccaaacgaagccgctcaattggccgcaaaatatcgtggacaagggtttcaaactctgaagctcaaggtagggaaaaacttgaactcagacatagaagttctgaaggctatacggcttgtgcatcccgactgctcgtttatcttggatgcaaatgaagggtacacagcaaaccaagcaattgaagttcttgacagactaaacgaaatgggagtgactcctgtactctttgagcaaccagtacatagagatgactgggaaggtctccgtgaagttagcattgctgctatggagaaatacagagttgctgttgctgctgatgaaagctgtcgaggcttacttgatgctcagaaaataatacatggaaatcttgctcatgttattaacatcaaactggcaaagttaggggttctgggaggcctcgaagtaattgatgccgcaagaaaagctggtattgcacttatgattggtggtatggtcgagaccaggattgccatgggctttgctggccatctcgccgctgggcttggttgtttcagttttattgacctggacacaccacttttattgtctgaagatccagtgtacggtggctacgaagcttctggaccagtctacaagttcaagaatgcccgaggccatggcggcttccttcatctggacaacaataatggatggaaatgaagatgcgcaacgcaagccatgtcgtcgtcctccgaggaggaactttataaagcatatcagcgcattcggtatagaacgtagaagttatcaaacgcgacgactatcgcgtggaactgaaatgtaacacaatcaattgtaagctatatatagcggtaaatctccctcccgttcatgtgctgctgtaagtcctgtgaggcctatagtatttgatcaggctgtagatagacacgttcagaaggccagcttggctggcgatgtttgctctagtgtagtaactggtagctgttccctcgagtgttcttctcctttgtatttttctggaataagtaaatgagactgccctttgagctaccaaagtttctgaggtatttatcgtcgaatgccgcggcatttgtgcatgagtaaaagagaattttgtgta

SEQ ID NO: 2857 - DNA, 1813 bp, Secale cereale
gactcgcgaatctcgatcgcccgcccgctcgtcaacgtccaccgagccatcgcttcgcagcgctgccggccatggacggctccatctccatctccatctcctccaccacatcctcctcatcccctctccgcttcgcccacaagcctcccagcccgagcccacgcctcaaccccgccccacgattcaccccatccggcgtcacccgcctccgcgccatctcgccgtcgccgacgccgaagcagcagaagcagcagcagccgatggaggcgttcggcttcgacgcgctcaaggagaccttctcggtggacgtggcggcggcggaggcgcgcccgctcaacgtgccgctcgccgcgcccttcaccatcgcctcctcgcgcctcgaggccgtcgccaacgtcgccgtgcgggtcgagctctccagcggcgccgtcggctggggcgaggcccccgtgctgccctccgtcaccgccgaggccagcccgccgcgctcgccgccgccggacgcgcctgcgccgcgctcgccgccgcccggagcgcgcccctcggcgccgtgctccaggacgtcgccgatgcgctccccggacacgccttcgcatcggccagagcaggagtggagatggcagtgattgacgcggtagctaacagcatccgcatacccttgtggagattatttgggggagcatcaaacactgtgacaacagacatcacgattccaattgtgaccccaaatgaagccgctcaattggctgcaaaatatcggggacaagggtttcagacactgaagctcaaagtagggaaaaacctgaactccgacatagaagttctgaaggctatacggcttgtgcatcccgactgctcatttatcttggatgcaaatgaagggtacacagcaaaccaagcaattgaagttcttgacagactaaacgaaatgggagtgactcctgtactctttgagcaaccagttcatagagatgactggcaaggtctccgtgatgttagcgttgctgctatggagaaatacagagttgctgttgctgctgatgaaagctgtcgtggtttacatgatgctcagaaaattataaatggaaaccttgctcatgttattaacatcaaactggcaaagttgggggttcttggagccctagaagtaattgatgctgcaagaaaagctggtattgcacttatgattggtggtatggtcgagactaggattgccatgggctttgctggtcatctcgccgctgggcttggttgtttcagttttattgacctggacacacctcttttattgtctgaagatccagtgtacggtggctatgaagcttctggacctgtctacaagtttaagaatgctcgaggccatggcggtttccttcatttggacaacaacaatggatggaaatgaagatggtgaacgcacgccttatcctccgggaggaactttataaagcatatcagcgcattcagtatagagcgtagaagttatcacacccgacgacaatcatgtggaactgaaatgtaagacaatcaattgtgagctatatatagtggtcaagctcccgtttatgtactgctgtaagtcctgtgaggcctataatatttgatcaggctgtagatagacaccttcagaaggccagcttggctggcattgttgctgtagtgtagtgtacaaccagtaactgttccctcagtgttctcctttgtattttcctggaataaatgagactgccctttgaggtagtaaaaacaaaaaaaaaactaaaaaagagaactagaccaaacggacgaaccaaccaagggggaagtaagggag

SEQ ID NO: 2858 - DNA, 2707 bp, Setaria italica
gcgttctcccttccctggactcctctcggtgggtggagactggagagagagaggcgccgaaggggcaacgggaggagagaagaagaaaacaactcagcacgggtggtagaggaggagaggagaggaaaggacggagaggctgcgccgtgccggcgagttggggtggatttccgacggccggagatgcgaccgtcgggacccggcgggaagtgcaattcggactcgggttcgtgggcggcacccgcggcggcggccgccacctgagcaggatgttcgactggaacgacgagcagcagcaggtaggggatgcaatatgggctgagttcaatgatagtgaagaccatattgtgccttaccctaaacatgcagaagatagtacgttagttagggttggaaatcacaagaacaatgatgaagaggcagcgagtatagcggacattactaaacattctgctggtgatcaaactgaacttcaagggatggaaaagcagcacgcaaatcagacaagtgcacatttttcagctacacgacttgacatggaatcctggcctgatctcccttctcttaatcctgcgcttgatagaaactatagtgatgataatatagcatctacgtatctggatttcagtgctgagcccagtttacagaaagtgaccggaaatactacagtgcagctggatggtgaatctgaagtgtttggtaatgatcacgaagaaaagagtagcagcttccttgattgtgactggggtaatattggtgacttcgatgattttgaccgtctatttagcaatagtgactccatattcggtaatgaagtggttgccaacgacagtgattttctttccgcatcttcagatatgatggataatgttgtgcaatcaattccgattccacaagtaccattgaataaacaaccattatctcatcatgggccttctttgcttctgattaatgaaatttctggtggcattaccaaacaagaaaacaagggagatgtgcagaagagaccagtgagatcacgcagaaaacaggaggaaagaggaaaaagtaaactatccagcgatacaagtggcttctcccagagcaaagtacagaatccatcagccagtttgcaagctcctatgcaacctgtccagactcctcaatatgcactgttccaggatagcaaaaacatggggcaagttcagcattctaatcagtttatttgtcctggatatgggtatcctgcatatccatttcctactattccattagtgtcaaacattcaagctgaagaccatcagaggaaaccagctgctacaagttaccaaacttcagcagattctccaaagcattcaagttccatagaaatgtcacaagatataccatcaaggccactgaggatgacaccaaaagaaaagattgaaaagcttaggcgcaggcagcaaatgcaagccctaatagctattcagcaacagcagcaacaatttggtcaagagggttctggcagtgacacaattgtacttcaaccatactccccgaggaacaaaaatgcggattctttagggagttcaattgtcatagatgaaaacacaaataaggactttttgcctgagatgatcccaacaagccacgacgaggttcacaaaagttttgcaatttcagaagatccctttatagaggaaaaaatatattatcagcttcaagatgctcttggcaagttggataccaaaactcgactatgtattcgagatagtttgcttcgtttggcctgtagtgccacagagagacaaattgctggtgacaggagtagcactaacaagactactaaagatgaagatgaagcttcagaacatgacacatctactaggagaacaagatctccaactaaggaagcagaaacaacaacaaatccaattgatcgaatagtagcccatttgctgtttcaaagacattgctctaaggttgcaacagcaactaaagaagaaatcatatcctcaacacacttgaagattgaacctgagtccaaggtacccttggaaactcctagggtgccatcagaagatcgcaaagacaagcaagaaatggtgttgcagccgtcacaataatatgctgatcaatgaactgttagacgccaacttgatagcaaatcagtggtggtggtgatgatggcaatctgctgatcatctgcggcactggagatcattaccttgtgtaccatgtaaccatttgaccattgtagcatccttttccacatccagcaagaacatctcagactggatagaaacctgcgattgtgtgtgagccctaaaaagagcgaacttggctctgccgctctagacatccttttgcttaactcgatgtcctctccagtttctcagggccatttttttccctctgtagagtaaccgtcccatgttttcaactagttgcttccttgagaaaatgttgatggctcataaacgcaagtgtctctgatagactgatgacacgtagagtattattttaagcgttttgacatacggttttagagtagtgtgaaaattgtgaatgatttttcatgaacaatgggtcgttattcttagtgctagatagttgtggcattcttggtaagctgtccaaccagcatgggaatatttattttggttttcgctattgctattgatgtgaactctccgatggttctattcctacttctactgatgggaaagatttccccttcgtactc

SEQ ID NO: 2859 - DNA, 2879 bp, Zea mays
gcggcctcgccgcccccgccatggggagtgatctcaaggagatgaagtacaggcggaggatcggggcggaggagcggccgcaatgcagcgaccggaggggcggcgcgggctgggccgcgctgcagcaggaccccgtcgagctgctgcgcaagctggacgagctgagggaccagatcgcgcgctcctgcaacgtcgtcgcccagcggcgggagccccgcagggccagccgccgcgcggtctccatgctccccgccgagcatctggaggagccaccgcctctgccggggtaccaccgctcccgccatggcgggcggtttgggccgggcttgccgcctccaggcccatacgcaccgccgcgccctgaacatggggaaaggtatgtgaggcagtctagcgggcactaccgccagtaccctgggaggcagtgggagaacggtgggatggggcctgggagcttccatcactacgggtgtgcctgtccacactgtctgcatgggcagaggacttcgccgcaagaggagaacatcccgatggcgaggtacttcgccaggcagcatgaatcgtaccggttcgagaggtcaccatctgtttcatccgattatgatcggaggtctgtggcgtcatcactttactcgcaccggtctgtatcgaagaggagagcagagtacttcaggaagaaggcggaacatatctgccgtccagtggatggtgctgcacctttctctgtgtgcagttcatgttataaactactgcagatgcctacagaaaaatgcatagggcggaagcagaaccgatttcaatgcgggtcttgttgtcagatagttagtctgaagcatgatgaagaaaatggtattccctttgcaccgtcattatccttatatgcgcctgaaacagagcaaagctcaagtgaccagatgaggcgagatactgtccatcaacatcatgaggattttaattctatgttctacaattcaaatgatcatagcaacatgcaaaacaacatggattccactgatgataattcactttcttcgaccatgagtaatgacaggattggcaaagattgtggttcaactagaagcattcagtcaaaagctgaggatctccctttctctccaagtaggtctgtagacaatggaagcccaaaggatatattgtgcgagagggacacagactgcaaggtggagccttctgtaggtggtccagttagcccacggtctccagctttagaggacaaacttgttgacccattgtgtgcccaagaaaaatgtaacgacgaggatgatcaaggcatggccatggcttacaaatcagacctaacttgcaaaggagaatatgatgttaatgatcagtatgatgggggcattagtacaagaagcaaacaggagagcaatgaagatgacaaagatgccactgaagatgaaatctcatgcagaagttatgaacagaagagcaaggaagataactcatgcaacattgaagatagtagcaaaacatatgagcagaatagtggagaagatgacactagtagtctagtaaatggaagtgaaaagtaccagtgtatgaatattaaagatgaagatagcagccccggaggcgaggacacatgcaataaatatgagtcaaaggtaaaaagagatgaaaattatgttcttggagctgagagcattagaaaaaactgtgatgaaaataatgcagatgtcatggaaactggaagcataagtgagagacatgatgggctgaaaatcgaagaagataatgagaaattgcagcagccatttattgaagatgccaattctcaaacagggagtggttcatcagttaatgagcggacaaattctgggttttctcgtggttcatcagaggctgggttggatgaagatcagtcctctaccggtaagagtggggattcatcattttttgctggttttctgaagaagggttttaaggacctttctttattaaataagtccatggacaatgttaaggtttcaattaatggtcatccaatctctgaaaaagcccttaagaaggcagagaagaaagctggtcctgttgacccaggtacatattggtacgactaccatgctggtttttggggtgtcatgggacgggaatgtattggcattgtccctccatttattagagaatttaattatccgatggccaaaaattgtgccggtggggatacaggtgtttttgtcaatggcagagaactgcatcaaagagatttagatttacttgtaggaagaggactaccacggacatctggcatgtcatattctattgagatgtcaggcaatgtaatcgatgaagcaactgggaaaaaactgcgcagtcttggaaaacttgctcctacgattgagaagttgaagcgtggttttggcatgcacgtccctgaagagttcagataagctggttctagtgctgaatattggctttgccaattatccactccacaaggctgaccatggggtgccaaaccaacgatttctgcgattgtgatgttaaatcgcaggtttctctgaattggactggggctctgcgagccaagataatgtggtccagtgacttaaccaccgattatagtatccctcctgctaatttcatcacttcaatggaagcgacgtttgctagtgactctagcctgccaggcagttcttaacttcactgctctgcctgtacatgttatattcctcaaatgtgtcgtctttatcagtacattgccccatcacaggcacagacatactgttagatgtatgagcaattgtcggcttgtaatttattggtagagctatgcttcccctaacatttatatgtatatatgtgctcatgattcttgaaactctggccgatatgattggctttcggctctcctg

SEQ ID NO: 2860 - DNA, 3161 bp, Zea mays
gtcgtctccgttacaacgcagacactgccgccgctccgcgacagtaactctgctctctctctctctcgcatggcgtactcctcgagccgcgggacgaaaccctaatggagaaccggcgccgccgccacgcccctgcgccgtagactcccctcgccgcagatagcgccagcgcttgccgatccggtgggaaaaaaaagtgggagcacggagcggcctcgcctcggcgggggaggcgcccgccatggggagcgacctcaaggagatgaagtacaggcggaggatcggggtggaggagcggccgcaatgcagcgacccgaggggcggcgcggactgggccgcgctgcagcaggaccccgtcgagctgctgcgcaagctggacgagctgagggaccagatcacgcgctcctgcaacgtcgtcgtcggccagccgcgggagcaccgcagggtcagccgccgtgcggtctccatgctccccgagcatctcgagccaccgcctctgccagggtaccaccgctcccgctacggtgggcggtatgggcacggcttgccgccaccaagcccatacgcaccgccacgccctgaacatggggaaaggtatgcgaggcagtctagtgggcactaccgccagtaccctcccaggcactgcgagaacggtgggatggggcctgggacctaccatcaccatgggtgtgcctgtccgcactgtctgcatgggcagaggactttcccgcaggaggagaacatcccaatggcgagatacttcgccgggcagcacgaatcataccggttggagaggtcgccttctgtttcatccgattatgatcgtgggtctgtggcgtcatcactttactctcatcggtctgtatcgaagatgagggcagagtacttcaggaagaaggcagaacatatctgccgtccagtggatggtgccgcacctttctctgtatgcagttcatgttataaactactgctgatgcctatggaaaaatgcgtagggaggaagcagaatcggtttcaatgtgggtcttgttgtcagataattagtttgaagcatcaggaagaaaatggtatcccctttgcacttgcaccatcatcatccttacatgcgcctgaaatggagcaaagcacaagtgaccagatgaggcaagattctgtccatcagcgccatgaggatttcaattttatgttcaacaattcaaatgatcattgcgatatgcaaaacaacatggatttcaccgatgataattcacttccttcgaccgcgagtaatgacaggattgagattgacaaagagtgtgggtcaactagaagcattcagtcaaaagctgagggtctctctttctctccaagtaggtctgtagacattggtagcccaaaggatatattgtgcgagagggataaagacagcaatgtggagccttcctcagatggtccacttagtccacgatctccaactttagaggacaaacttgttgacccgttgtgtgcccaggaaaaaggtaacgatgaggacgatcaaggcacggcttacagatcgaacctaacatgcaaaggagaatatgatgctaacgacgagtatgatggggacgttagtacaagaagcaaaccggagagcaatgtaaatgacaaagataccactgaaggcgaaacctcatgcagaaattacaaggaagacaactgttgcaacattgaagatagtagcaaaacatacgagcagaatagtggagaagatgacaccagtagtctagtagatggaaatgagaagtatgagtctatgaatactaaagacgatgatagcagccctggaggtgaggacacatgcaataggtatgagccaaaggttgaagacgatgaaaattgtgttcttggagctgagagcattagcaacaattgtgatgaaaataataaagatgccataaaaactggaagcataagtgagagacatgaagagctgataattgaagaagaaaatgagaaattgcagcaggcatttattgaagatgccaattcccaagcagggagtggttcatcaattaatgagcggacgaattctgggttttctcgcggttcatcagaggctgggttagatgaagatcagtcctcaaccggtaagagtggggactcatcattttttgctggtttcttgaagaagggtttcaaggacctttctttattaaataagtccatggatagcgttaaggtttcaattaatggtcatccaatctctgaaagagcccttaagaaggcagagaagaaagctggtcctgttgacccaggttcatattggtacgactaccgtgctggtttttggggtgtcatgggacgagaatgtatcggcattgtccctccatttattagagaatttaattatccgatggccagaaattgtgccggtggggattctggtgtttttgtcaatggcagagaactgcatcaaagagatttagatctacttgtaggaagaggactaccacggacatctggaaaatcatactctcttgagatgtcaggaaatgtaattgatgaagacactggaaaaaaactacgcagtcttggaaaacttgctcctacgattgagaagttgaagcgtggttttggcatgcacgtccctgaagagtttagatagctggttctagtacaggatcttggttttgctaataatacactcttcaaagctgacaatggggtggcaaacgtgtggcttctgcgggacggtggtatcaaatctcagatttcttggactggagctctggaagcagcagtacttaagatccttggtgtgcggcgaaggttgtctggcactcaagaaaccaagataatctggtctaatgacttgactaccaatagtatccctcctgctaatttcaattgcttcaatggaagcgacgtgtgctgctagtgactctagactatcaggcagttcttaacttcactgctctgcctgtacgtgctattccttgaatgtgttatcattatcggtacattgccccatcacaggcatagaagtgttgtcagatgtaccatgagcaattgtcggcttgtaatatattggtagagatatgcttcccctaatatttatatgtatatatatgtgatcttgattcttgaatctcttgccaatacgattgattcctgaaccctgttaataagagtcttatttt

SEQ ID NO: 2861 - DNA, 3328 bp, Setaria italica
tctctctctctctctctcatggcggactcctcgagccgcggggagaaaccctaatggagagccggcggcgcagccacgcccccgcgccgtagcctcgacgcagacaacgccggcgcttgccgatccggtgggaaaggtggggggagtctcgcctggcggggaggcgcccgccatggggagcgatctgaaggagatgaagtacaggcggaggattggggtggaggagcgcccgcaatgcagcgacccgaggggcggcgcggactgggccgcgctgcagcaggaccccgtcgagctgctgcgcaagctggacgagctgagggaccagatcacgcgctcatgccacgtcgtcggccagccgcgggagcaccgcagggtcagccgccgcgcggtctccatgctccctgaacaccttgagccgccacctcagccggggtaccaccgctcccgctatggtggccggtatgggcacggcttgccaccacccagcccatacgccccgcagcgccctgaacatggggagaggtatgtgaggcagtctagtgggcattaccgccagtaccctgggaggcagtgggagaacggtgggatggcgcctgggagctaccatcactatgggtgtgcttgtccgcactgtctgcacgggcagagggctgcgccgcaagaggagaacatcccaatggcgagatactttgctgggcagcatgaatcataccggtttgagaggtcaccatctgtttcgtctgattatgatcggaggtccgtggcgtcatcactttactctcatcggacggtattgaagaggagggcagagttcttcaggaagaaggcagaacatatctgtcgtccagtggatggcgctgcaccttttgccgtgtgcagttcatgttataagctactgcagatgcctgtggaaaaatgcatagggaggaagaagaatcggtttcaatgtgggtcttgttgtcagataatcagtttgaagcatgatgaaggaaaaggaattcccttgacaccatcatcatccttatatgtgcctgaaatggagcagagctcaaatgatcagatgatgaaagattccactcatcagcgccaagaagatttcaattccgtgttctacaatgcaaacgagcatagcagcatgcagttcaacatggattttgctgatgataattcactttcttctaccaccagtcatggcaggactgacaaagaatatgggtcaaacaggagcatccagtcaaaagcagagggtctctctttctctccaagcaggtctctggatgctggtagcccaaaggatatattgtgtgaaagagatgcaggctgtgaggcagagccttcagtagatggttcagttaccccacgatctccagttttagaggacaaacttgttgacccattgtgcacccaagaaaaaggtaacaatgaggatgcaatggcttacagatcagacataacttgcaaaggagaatatgatgttaatgatgactatgatgagagcgttagtacaagaagcaaacaaaagggcaatgatgatgacaaagatgctactgaagatgaaagctcacgcagcagttacgaacagaaagacaaggaagataactgttgcaaccttgaaggtggtaacaaaatgcacaagcagaatagtgtgaaagatgacagtagtagccttgaagatggaagtgaaaagtatgagtatacaaacattaaagatgacaatagcagccctggaggaagtgaggacagcagtaaatatgagccaaaggccaaaggagatgaaaaatgcgttcttggatctgaaaacattagcaacaactgtgatgaagacaacaaagacaatgccatcgaagctggaagcacaagtgagagacatgacgagctgaaaacggaagaagattatgggaaattgcagaggccatttactgaagatgccaattccccagcagagagtggctcatcagttaatgggcgcacaaattctgggttttctcggggttcatcagaggctgggttagatgaagatcagtcctcaactggtaagagtggggactcatcattttttgctggtttcttgaagaaaggcttcaaggacctgtctttattaaataagtccatggacagtgctaaggtttcaattaatggtcatccaatctctgaaagagcccttaagaaggcagaaaagaaagcaggtcctgttgaccctggttcgtattggtacgactaccgtgctggtttttggggtgtcatgggcagagaatgtattggcattatccctccatttattagagaattcaattatccgatggccagaaattgtgccggtggggatactggtgttttcgtcaatggcagggagcttcatcagagggatttagatttgcttgtgggaagaggactgccgcggatatctggaaagtcatattctattgaggtatctggagatataactgatgaagcaactggaaaaaagctacgcagtcttggaaaacttgctcccacgattgagaagttgaagcgtggttttggcatgcacgtccctgaagagtttagatagctggctcttgtacagcatcttggttttgctcataatgcactcttcaaagctgaccatgggtggccaaatctgtgatatcttgtgatattaaatctcagatttctccaagttgttggactggagctctacaagtagtacttaaatcctgggtttcctgaacatgatgctactcaagaagccaggatcatgtggttaagtgacttactaccaataatctccgtcctgctaattccattcctttgatggaaggaagtttgctagtgactcagtctatcaggcagctctaacttcactgctctgcctgtacatgctattctttatctgtgttatcattgtcggtacattgcccgcccgccccatcacaggcacagaagcgcatatttagatgtatgagcaattatcggcttgtaatatattggtagagctatgcttcccctaacatatatatgtatatattggctcttgattcttgagactccttgccgatatgatggcattcccctcccctggagctcccctggctcgttctgtatgtgcaactcatcttgcccatataatgtacagctgcaattctgatgccaaacctggtattcaagatcacgggcatggccgcagttgctcaggtacaactgtacaccagctgtcattgtattaacttgcttcgcatgaatgtgtcacttgcaggcttgcaactatgcatgaagctgctggatcttcagcattcctggaactgttatcgtgagctgacggggttgcaagaagctgctagatcttcag

SEQ ID NO: 2862 - DNA, 2233 bp, Setaria italica
ggaatgtcggcgcccatcgatcggttcgcgacgacaagagatgaaggtcatgcatgcagcgatgaaaagagagagtgcaattctgatgaagaaaactcagaaggagaaaggagggtcaaaaggggctctttcaagaagagagctattactgcagggtataaatttaggcattccttaaggaggaagagtagaacgaagagtggcaaccatgtagtctccattgaagacatcagagatgttcaagagctggagactgttgaaaggttccgccggtgtttacttgatgagggcttgttgccagaacgtcatgatgattatcatacgatgttgaggttcctgaaagcaaggaaatttaatattgagaaagcaaagcatatgtggtcagaaatgcttagatggagggaggaatttggggccgacaatatagaggaatttgattacagtgaattacatgaagttgtgaaatactatccacaattttatcatggtgtggacaaagagggaaggcctgtttacatagaactaattggaaaagttgataccaacaaactggtacaaatcacaactattgaccgatatgtaaaatatcatgtcaaggagtttgagagatgtcttcagatgaggtttccagcttgctctattgctgcgaaaaagcatatagactcgtccactactatcttggatgtgcaaggagtgggcctaaagaacttctcaaaagatgcaagggagctaataatgcgattacagaagattaacaatgacaactatccagagaccttataccaactgtacatcataaatgctggccaaggtttcaagatgttatggggtacaataaaatcatttcttgatccagagactgcttcaaaaatccatgtccttggaagcaagtaccaagctaaattacttgaaatagttgatagcagcgaactcccagattttcttggtggcaagtgcaggtgtgaagaacacggaggttgttcgaaatcagataaaggcccttggaaggaccctgaaattatcaagagggtcctcaatggtgaagcaaattatggtcggcgagttcttgctgtatcaagcatcaatcagaaggaagttggctgtactgagcctcaacacacaactggaaagggcaatgatgtgtctgccgaatctagttctgaggtggaagacgtttcttctcctactgcttcagtgaaccccatcataatccctaatttgacccatgttcacgagtcaaaatttccaggacatgcttccacatctgatgctcctcccattgtagaggataacatccctgttgtcaacaaggttgtggatgcatgctctgatccaagaaacagctccatggcttccacctcaggttctttctccttgagaaatacacctgcaacactgggaggacttaaaactcaaattgttgcgtggttgacagtcttaatcgtgagccttttggcattccttcgttctgtcccgaccataatgactaaaaggctcacaaatcaggtcattacctgtgatcactatagtgccgagtaccctcctcaaggaaatacaggaaatggtacccttacatctgttttaagacggctaggtgaattggaggagaaggtacagacacttgaagtaaagccacaccaagtgccatttgaggaggaattgctaaacgcagccatccgccgtgtggatgcattagaagctgagctaatttctatgaaaaaggccctttatgaggctttgattcggcaggatgagctgcttgcctatattgaccggcagcagcaagtcaagttttgcagaaagaagaagtgcttctaagtactggagcacctgccgccaccttttccccttctcttccgagatggcgtgctgctactgttgatccagaatacttacaaatgttttcatttttccttgtaaaatattgtaattattagaaatagataggaatgagacattgagtagctgggccagccacaacttcttgtgagatcttgtttcagcaggaaaggaaaagaaagtttgagatcttgtttgcacgttcaagttcgaccgagatgcaggcttaatgtttccctgcctttgctgtaggacggttactagggccttgtttagttcccaatttgggagtggcaaaattagcattttaccataaatgcgtaaatgtagcatttcgtttgtatttgtgaattattgtccaaacattgactaattaggctcaaaagattcgtct

SEQ ID NO: 2863 - DNA, 2041 bp, Panicum virgatum
  misc_feature (538)..(538): n is a, c, g, or t
  misc_feature (648)..(648): n is a, c, g, or t
  misc_feature (743)..(743): n is a, c, g, or t
  misc_feature (1218)..(1218): n is a, c, g, or t
  misc_feature (1244)..(1244): n is a, c, g, or t
gagagtgcaattctgatgaagaaaactcagaaggagaaaggaaggtcagaaggggcactttcaagaagagagcgattaacgcagggcataaatttagacattccttaagaaggaagagtagaacgaagagtggcaaccatgtagtctccatagaagacataagagatgttcaagagttggagattgttgaaaggttccgccggtgtctgcttgatgagggcctgttgccagaacgtcacgatgattatcacacaatgttgaggttcctgaaagcaaggaaatttaatatcgagaaagcaaagcatatgtggtcacagatgcttaaatggaggaaggaatttggggccgacaatatagaggaatttgactacagtgaattacatgaagttgtgaagtactatccccaattttatcatggtgtggacaaagatggaaggccagtttacatagaattaattggaaaagttgatacaaacaaactagtacaaatcacaactattgaccgatatgtaaaatatcatgtcaaggagtttgaganatgtcttcagatgcggtttccagcttgctctattgctgcaaaaaaacacatagactcgtctactactatcttggatgtgcaaggagtgggcctaaagaacttctcaaaanatgcaagggagctaataatgcgattgcagaagatcaacaatgacaactatccagagaccttacaccaattgtacatcataaatgctggccaaggnttcaagatgttatggggtacattaaatcatttcttgatccagaaactgcttcaaaaatccacgtccttggaagcaagtatgaaactaagttacttgaaataattgatggcagtgaacttccagattttcttggtggcaagtgtaggtgtgaagaatatggtggttgtccgaaatcagataaaggcccttggaaggaccctgaaattatcaagagggtcctcaatggtgaagcaaattatggtcggcaagttcttgctgtatcaagcatcaatcagaaggaaggttgtactgaacctcaagactcaactgatcagggaaaaggcaacgatgcctctgctgaatctagttctgaggtggaagacgtttcttctcctactgcttcggtgaaccctatcataagccctaatttgacccatgtgcacgagtcaaaatttccaggacatgcttccacatctgatgctcctcccattgtagnggatagcatccctgttgttgacaagnttgtggatacatgctctgatccaagaaacagctcaatgtcttccacctcaggttctttatccttgagaaatacacctgcaacactgggaggacttaaaactcaaattgttgcatggttgacagtcttaatcgtgagccttttggcattccttcgttctgtcccgagcataatgactaaaaggctcacaaatcaggccattacctgtgatcactatagtgccgagttccctcctcaaggatatacgggaaatggtacccttacatctgtgttgagacggcttgatgaactggaggagaaggtacagacatttgaagtaaagtcaccccaagtgccattcgaaaaggaggaattgttaaatgcagccgtccaccgtgttgatgcgttagaagctgagctaatttctatgaagaaggccctgtatgaggcattgattcggcaggatgagctgcttgcctatattgaccggcaacagacaatcaagttttgtagaaggaagttgtgcttctaagtcctggagcacctgctaccttttccctttctcttgcgagagatggcgtgctgctgctgtcgatccagaatacttgcaaacattttccatttctttcgttgtaaagtactgtaatcagtaggaatctaggaatagatagggttggagacattgagtagctgtgcagcttctgtccataccttgtttcagcaggaaaggaaaaaaaaaggtttgagatcttgtttgcatgttcacccgagatgattacagccatggtgatggattttacatgccgtttttcttttgaac

SEQ ID NO: 2864 - DNA, 2453 bp, Panicum virgatum
gtgagtgccaagatgttttcttgcttcacaactacatgtccttgacgattcctttacgctacgcgctgtgctttcttgtttcggtgtcgtggggggttggcaagtgcgtttggttcatctcggttcagttgtagctgcgtttgttgtattattaagattgtttcttttgggctcaatactgtcagtcaagaagatgagaaataactcaaagcaacacacgccctctctgaattgcataatttgattcgagaagccgagattatttctgctaaattgatgccctggggtgaacgttgtgatttttactcttctagtctggtgcatatgaattatgacatcaatttagcttttttttccaacgtgccaatgactgcgtagtttttcgttcattgtgtagcatgtctatgaaggccatgcacgcagcgatgagaagagagagtgcaattctgatgaagagaactcagaaggagaaaggaaggtcagaaggggcactttcaagaagagagcgattaacgcagggcataagtttaggcattccttaagaaggaagagtagaacgaagagtggcaaccatgtagtctccatagaagacataagagatgttcaagagttggagattgtcgaaaggttccgccggtgtctacttgatgaggacctgttgccagaacgtcacgatgattatcacacaatgttgaggttcctgaaagcaaggaaatttaatatcgagaaagcaaagcatatgtggtcaggaatgcttaaatggaggaaagaattcggggttgacaatatagaggaatttgactacagtgaattacatgaagttgtgaagtactatccccaattttatcatggtgtggacaaagagggaaggcctgtttacatagaattaattggaaaagttgatacaaacaaactagtacaaatcacaactattgaccggtatgtaaaatatcacgtcaaggagtttgagagatgtcttcaaatgcggtttcctgcttgctctattgctgcgaaaaagcacatagacttgtctactactatcttggatgtgcaaggagtgggcctaaagaacttctcaaaagatgcaagggagctaataatgcgattgcagaagatcaacaatgacaattatccagagaccttacaccaattgtacatcataaatgctggccaaggcttcaagatgttatggggtacaattaaatcatttcttgatccagaaactgcttcaaaaatccacgtccttggaagcaagtatcaaactaaattacttgaaataattgatggcagtgaacttccagattttcttggtggcaactgcaggtgtgaagagtacggtggttgtccgaaatcagataaaggcccttggaaggaccctgaaattatcaagagggtcctcaatggtgaagcaaattatggtcggcgagtttttgctgtatcaagcatcaatcagaaggaagttggttatactgaacctcaagactcaactgatcagggaaaaggcaacgatgcctctgctgaatctagttctgaggtggaagacgtttcttctcctactgcttcagtgaatgcagtcaaaatttccaggacatgcttccacatctgatgctcctcccattgtagaggatagcatccctgttgttgacaaggttgtggatacatgctctgatccaagaaacagctcagtggcttccacctcaggttctttctccttgagaaatacacctgcaacactgggaggacttaaaactcaaattattgtgtggttgacattcttaatcgtgagccttttggctttccttcgttctgtcctgtgcataatgactaaaaggctcacaaatcaggccattacctgtgatcactatagtgccgagttccctcctcaaggatatacgggaaatggtacccttacatctgtgttgagacggcttgatgaactggaggagaaggtacagacatttgaagtaaagccaccccaagtgccattcgaaaaggaggaattgctaaatgcagccgtccaccgtgttgatgcgtgttgatgcgttagaagctgagctgatttctatgaagaaggccctgtatgaggcattgattcggcaggatgagctgcttgcctacattgaccggcaacagacagtcaagttttgtagaaagaagctgtgcttctaagtcctggagcacctgctaccttttccctttctcttgcgatagatggcgtctgctgctgtcgacccagaacacttgcaaacaatttttcatttttttcgttgtaaagtactgtaattattaggaattagaggaacagatagggttggagacattgagtagccgtgcagcttctgtcgagaccttgtttcagcaggaaagggaaaaaaaggtttgagatcttgtttgaatgttcacccgagatgattaccgccatggggatggattttacatgccctgtttttttt

SEQ ID NO: 2865 - DNA, 2137 bp, Pennisetum glaucum
cgaggaagggaatgtcggcgcccatcgatcggttcgcgacgccgattgatgaaggtcctgcacgcagcgatgagaagagagagtgcaattctgatgaagaaaactcagaaggagaaaggagggtcaaaaggggctctttcaagaagagggcaattactgcagggtgtaaatttaggcattccttaagacggaagagtagaacgaagagtggcaaccatgtagtctctatagaagacataagagatgttcaagagctggagactgttgaaaggtttcgccagtgtttacttgatgagggcttgttgccagaacgtcatgatgattatcacacaatgttgaggttcctgaaagcaaggaaatttaacattgagaaagcaaagcatatgtggtcagaaatgcttagatggaggaaggaattcggagccgacaatatagaggaatttgactacagtgaattacatgaagttgtgaagtactatccacaattttatcatggcgtggataaagagggaaggcctgtttacatagaactaattggaaaagttgatgctagcaaactagtacaaatcacaactattgaccgatatgtaaaatatcgtgtcaaggagtttgagagatgtctccagatgaggtttccagcttgctctattgctgcaaaaaagcacatagactcgtccacttctatcttggatgtgcaaggagtgggcctaaagaacttctcaaaagatgcaagagagttaataatgcgactgcagaagatcaacaatgacaactatccagagaccttacaccaattgtacatcataaatgctggccaaggcttcaagatgttatggggtacaataaaatcatttcttgatccagaaactgcttcaaaaattcatgtccttggaaccaagtaccaaactaaattacttgaaataattgatggcagtgaactcccagattttcttggtggcaagtgcaggtgtgaagcatacggaggttgtccaaaatcagatagaggcccgtggacggaccctgaaattatcaagagagtcctcaatggtgaagcaaattatggtcggcaaattcttgctgtatcaagtatcaatcagaaggaagttgattgtactgagcctcaacacacaattggaaaatgcaatgatgcgtctgctgaatctagttctgaggtggaagatgtttcttctcctactgcttctgcgaaccccatcataagccctaatttaacccatgtgcacgagtcaaaattttcaggacatgcttccacatctgatgctcctcccattttagaggatagcatccctactgttgacaaggttgctcctcccattttagaggatagcatccctactgttgacaaggttgtagacgcgtgctctgttccaaggaacagctccatggcttccacctcaggttctttctccttgagaaatacacctgcaacactgggaggacttaaaactcaatttgttgcatggttaacattcttaatagtgaaccttttggcattccttcgctctatcccaagcgtaatgactaaaaagctcacaaaccagcccattacctgtgatcattatagtgctgatttccctcctcaaggatatacgggaaatggtacccttacatctgttttaagacggcttggtgaattggaggggaagttacagacacttgaagtaaagccaccccaagtgccatgtgaaaaggaggaattgctaaacaatgccgtccgccgtgtggatgcattagaagctgagttaatttctatgaagaaggccctgtatgaggctttgattcggcaggatgagctacttgcctatattgaccggcagcagcaagtcaagttttgcagaaagaagttgtgcttctgagtactggcgtgctgctattggtgatcgagactacttgcaaatattttcgttttcctgtaattattagaaacttagaaatagataggaacgaatcaacgaaacttgagtagctgggcaagccacaacttcttgttagattcttttgtttcagcaggaaaggcaaagaaggtttgagatcttgttttcatgttcaagttcaaccgagatgcaggcttaaatgtttccctgcctaggtaatccttgtgcagagtcttctcgttttg

SEQ ID NO: 2866 - DNA, 3896 bp, Setaria italica
gaccaggatgaggagatgctggttccgcatcaagatgttatcgagggcgcgcagcaggccgtcgtcgaaggtccgcagcaggatgtcgtcgagggtccgcagcaggatgttgtggagggtccgcagccgatggaagaatctgcatcaactgttgagaaccaaactgtgccagatccctgtacatccagatttacatggaccattgaaaatttcttcaaacgcaatgttagaaagcattactctgatgattttgtcgtcggaggatacaaatggcgagtgctggttttccccaaaggaaataacgtagataacctttcaatgtacctggatgttgctgatgcaaattttctgcctcctggatggagtaggtatgcacaattcagccttgctgtggtaaaccaaatagacagcaaaatgtcgttaagaaaagaagcaacacatcaattcaatgcccgagaaagtgattggggcttcacatcttttatgcctttgatggatctatatgattcaagtaaaggatatgttgtgaatgataaatgcattattgaagctgaggttgctgtgcgtaaaattgttgatttctggaactatgactccaaaaagatgaccggttatgtcggcctgaagaatcaaggagctacatgttacatgaactctctccttcagactttgtatcacattccctactttcggaaggctgtatatcatatgcctacttcagagaatgatacaccttcagggagcattccgctcgctttgcaaagtcttttctacaaacttcagcataatgacaatagtgttgctacaaaagagctcaccaaatcctttggatgggatagctatgattcattcatgcagcatgatgttcaagaattgaatagggttctctgtgaaaagctggagaacaagatgaaggggaccactgtggaaggagcaatacaaaagttatttgagggtcaccatatgaattatatcgagtgcattaatgttgaccacaaatctaccaggaaagagtcattctatgatcttgcacttgatgtcaaggggtgttctgatgtctacgcatcatttgataagtatgttgcagtggagaggttagaaggcgataataagtatcaatctgaggaacatggtctgcaggatgccaagaaaggaatgctttttgttgacttccctccagtcttgcaacttcagttaaaacggttcgaatacgattttgtgcgggatacaatggtcaagataaacgaccgctatgagttcccacttcaattggatcttgatagagatgatggaaaatatctttctccagaagcggatagaagtgtgcgtaacctatatactcttcacagtgtactagttcatagtggtggagttcatggaggacactactatgccttcattcgcccgacgttgtctgaccaatggtacaagtttgatgatgaacgggtaacaaaagaagacacgaagcgggctttagaggagcaatatggtggtgaagaagagctcccccataccaaccctgggctgaatacaacccccctcagatttactaagcattcaaatgcctacatgcttgtttacattcgagaaagtgacaaagagaaaattatctgtgatttggacgaggaagacatatcagaacaccttaaggttaggttaagaaaggaacaggaagaaaaggaatacaagaaaagggagaaagctgaggctcacatgttcactgcgttgaaggtggcctgggattctgatttgaaagagcaaattggaagacatgtgcactttgatctcgtggactttgacaaagttcatagcttccgtgcacctaagaacatgtcaatcaacgaggtcaagatggagctttcaaaagaatttggcatcccggtggaatcccaacgattttgggtgtgggctaagcggaagaacagtacctacaggcccagtcggccgttgacccttcaggaggaaaaaactgctattgggctgcttaaagatgcaactgtaacaaaatttcagacttctgaagtaaggctattcttggaggttcattttggccaggaaaatcaaccgattgctcctcctgtgaagaccaaagaagatatattacttttcttcaagctctacgatcctgaaaaggaagacctaagatatgttggaaaattttttgtgaaagcatcggggaaaccatttgatatagtagaaaggctgaatcagatcgccggatttccgtctgatgaagatattgatctctatgaggaaataatgtatgatccaagtgtgatgtgcgaaccaattgagagtaatgtatctttccattcaagccagattgagaatggtgatataatatgctaccaaaaacgctgtttgccagataaaatggatcaatatcgctatcctactgtatcttctttcttcgaatatattcataataaacagattgttcgcttcagattgctggagaagccaaaagaagactacttctctctggagctttcaaagcgttccacatatgatgatgttgttgagaaggttgctcatcaacttggtctggatgaaccttctaaaattcggcttactcaacaccatccactttctcaccaacccaaaccttactacatcaaatacagaggtcttgattatctttcggacatgctacagcatcacaatcagatgtgtgacatattatattatgagacactggacattccgttgcctgagctggaaggtctgaaaacactgaaagttgcttttcaaaatgcgaaaaactgtgaggcgtcatttcacattatgaggtcaccaaaaagtaatgctctttttgatttgatcgaagacttaaagtcaaaggttgaactttcttgtaatgatgctgaatttcggtttttcaatgtccaccttcacaagatatgcaaggtttatcaaccaggagataagatagattcagttagtgaccaatctggaccccttcgtattgaagaggttcctgaggaagagaaaaatgctgggcctaatgaccgtttggttcatgtctatcacttcttcaaagatattcatcatattcaatattttggagaacctttcttctttttaattcgtgatggtgaggctttgtcggatatcaaagtacggattcagaagagacttcaagttcctgatgagcagtttctaaagtggaaatttgcttatgttacatacggtcggccagaatacctccaagattcagatattgtattgagccgattccagaaacagaaacctatttatggggcgtgggaacatattcttggattggagcatacagctactaccccaaaaaggtccttcttagccagtcagaaccgtcattcttttgagaagccagtgaagatttacaactaaaagtggcaatatgttgttgtgcgaggaattgagaactggatatgagggcgctgtcttgttccaaaagcaatctcattatgtttttggtcatgtacagggtggaaggctttgcatagagtagatccgtggcagtttatctaaagaattttcatttggtggatgtacagggttctatagcaacctttccttgtagaaagtttctggaagctgtaaatcggggtccgaccaccgtgttcttttgcgttccccagcactgttctgtgggaagttgttaacattagcctcggagaacctgttacaggtctaaatacaattgattcagtgttctgttgtttttatcgtttcttaaggctgtgaccttttttatccgtttggtggtacctagcggtagaattgatcaagtttacagttgtggctggctgtcgtttgaaatgtcgaagccgattcatttggcaaagtatttgcctgtttggtgagcagctgaacttgaatagaaaaacaggtttccgtcgcttgttattggt

SEQ ID NO: 2867 - DNA, 2476 bp, Zea mays
gggagagggaagcgaaatgcgaaaggcagccgaggccgcgagccgacgcacgcggctcgttgcttcctccatcccctttcctcacgccgacgccaaagtataccaacgaattcctcctcgggctcccacctaatcgtgttcgccgcctgcctctcccaaaccctagcaacccacgatcgaacccaaatccgctcctcccacccgaggaattatgcgaaattccccgagatcctagcccagcactagcagatcgatccatcgcttgcccacctgccggccaccaacccttgtagtctcagtcaatctgtagattgagactacgatgagcctgtcaccgctcgactcctcctccccgccggccgcggctgcggctgctgctacggaggtgcccctcgccccgggcttccgcttccaccccaccgacgaggagctcgtctcctactacctccgccgccgcgtcctcggccgccgcctccgcgtcgacgccatcgccgagatcgacctctaccgcctcgagccctgggacctcccctccctctcccgcatccgcagccgcgacgcccagtggtacttcttcgcccgtctcgaccgcaaggtcgccggcgctggcgccgggggccggggcggtcccggcaacaggaccaaccgcgctacgccgagggggtactggaagaccacgggcaaggaccgcgaggtgcaccaccgcggcaagcccgtcgggatgaagaagacgctcgtcttccacgccgggagggcgcctaagggcgagaggaccaactgggtcatgcacgagtaccgcctcctcgatgcagacggacctcaggatctgcatgtggtttgtagaatcttccagaagcatgggtctggaccacagaacggtgcgcagtatggtgcaccatacatggaagaggaatgggaagaggatgatgatgctattgagaatggttctacccacgatgcatctggtcaaattgctgcaaccacctgtgctgtagatgaggagtcaaatgaggacgatgagaatgcatattgtgaaacaaacagacctgctcgagtagaaccatctcatctgccttcggtccatgaaatgctcaatccaccagagatggctcctctccaaggtcaagattctaaagagacaagcgatggaagttgttctgatgttgctatttctctggaagagattttgcaggaacctttgtcaaatattagtgtggagaatatgcatagacttgaagggcagaatgccactgatgataacatcagtgttgataacttgttatcagcatatcccacgaaagataatggctacgtaggccagtataacactatgaatgggagtgctccagcagatgaagctcacgcacgctggcctttgagaacatatagtaatcagaattatgtcaatggccctcttgctgatgagttctttgacacagggaatgataccaatggggttgcatattccaggcagcagcaagctgatggcttcccagcacctcgccaagttgatgaaagtatggtattttatgatgccccatctgattacaacttggtggatggaaaagatgacttcgtatatctgaacgacattctgaatgagccacttggaaatgaatcgctctttgatggagatgatatgatggcttactttgatgccacagagaatgatttcaagtatgacattttgggctctggtcagggtttggattatccacttgcagacatgccgttgaactttgcccaaaagagtgacaaggaagacaagtttacattcgaagggatctctgaggttccggaagcaaatcctcagtacggtgcatcctcatctggttcacatgaagatctgtatactgatactgaatttctaggtgtaccaacagatgacactgctgataaaacttacggaaatcgcctggccagcatgttaggctctatcccagctccacctgcaatggcctcagaattcccgccgtcaacagggaaatctgctgggatgctttcggctgtcagctcgagctcaattcgttttactgctggtatcatccaacttgatggcctcactttcagcagcggctccggtcagtggcccttgcagaagaatggagacttgagtttgcttgtctcttttgctgtggagggcgacgtggcatccaagctccctgttggtcttgggcgtgctactcggattagcaccgttcccatggtgctgcgcagtggtttttaccttttctttatgtcggccatgattctcttgtttagctacaaagtagggtcgtgtatctacagcaggtaagttgaagttgatggcgcctcttgtccggccagacctgtgggctgtttattttagttcaacacgtggatcattccctcagtgatgggggtatagcagtcgttcgacaccttttttacacatttaccattttgacctgtcaaaacatacagcaataaactttcgaactggtggtggtgatca

SEQ ID NO: 2868 - DNA, 2570 bp, Panicum virgatum
tttgtcttcgtctccctcacgccaaagccaaatcctagcaccagcgacttcaacctccacctccttgggttcgcatcctcacgccaccacacccaaaccctagcaaacccgatccccccacaaccccaaccccaacccaatccgcccgcccaaaaagtcatgcgagatcacccgacatcctagcccccccaaccctagcagatatcagcagatccagatatgagcaccagcctgtccccgcccgactcctcgccgccgccggcggaggtccccctcgccccgggcttccgcttccaccccaccgacgaggagctcgtctcctactacctccgccgccgcgtcctcggccgccgcctccgcgtcgacgccatcgccgaggtcgacctctaccgcctcgagccctgggacctcccctccctctcccgcatccggagccgcgacgcccagtggtacttcttcgcgcgcctcgaccgcaaggtcgccggggccggcgccggcggccgggggggcccggggaacaggaccaaccgcgccacgccgcggggatactggaagaccacgggaaaggaccgcgaggtctaccaccgcggcaaggccgtcggcatgaagaagacgctcgtcttccacgccggcagggcgcccaagggggagaggagcaactgggtcatgcacgagtaccgactccttgacgccgacgggccccaggatctgcacgtggtgtgtcgaatcttccagaagcatggttctggaccacagaatggagcgcagtatggtgcaccatacatggaagaggaatgggaagaagaagatgatgctattgagaatgcacctgctaatggcacatctgccggaatggctacaatcacatgtactgtagatgaggagtcgaacgaggaggatgagaatggatattgtaaaaccaatgagcttgctcaggtgagtagtaccatcttgtttgcctttggcccatggaatgctcagctcacctgagatggcccctctcaaagctcaaggttccaaagacaccggtgaaggaagctatgctgatggtgttatttctctggaggagattatacaggaacctttgtcagctattaatgcagagaatgtagatagatctgaagggcagaatgccactgatgataacttcagtgttgacgacttattatctgcgtgccccaggaaagataatgactacgtaggtcaggattgcactctgaatgggagttacccggctgatggcgatgacacacattggcctttgagagcatatagtaatcagaactatgccaatggtactcttagtgctgaggagttctttgacacacagaatgatagcaatgggaatacatattcagagtaccagcaggttgatggctttccagcacctcaccaagtggatggcagtatggtattttacgatgctccatctgattacaacttggtggatggaaatgatgacttcgtatatttgaacgacctcctcaatgagccttttggaaatgaatcactctttgatggagatgatatgatggcttactttgatgccacggagaatgatttcaagtatgacattttgggttctgctcaggattcaaattatcaacttgcagacatgccatcaaactttgcccaaaagggtgataacaaggacaagtttgcacttgatgggatctcgaagtctttggaagcaaatactcaatatggtgcgtcttcatctggttccctcaaggatatgtatccagatactgcagtaccaggtgtgccaacagatgacactgttgataaaactttcggaaagcgccttgccagcatgttgggctctatcccggctccacctgcaatggcttcagaaccgtcagcaactggaaaatctgttggcgctctctcggctgtcagcccgagctcgattcgtgttacagctggcatcatccaactcgatggcctcacttttagtggtgtctctgagcggtggcccctgcagaagaatggagacttcaatttgcttctgtcttttaccgtggagagcgatgtgtcatccaagcctgctggttttgagcaggctacacggattagcaccatcccgatggtgctgcgcagcggcatgtatcttttctttgtatcagccatgattcttctgttgagctacaaagtagggtcgtgtgtctacagcaggtaagttaatgtggccccgttctgtctgagggctgttacatttgatttggaacgtgtcccctcaacgagggtataacaatggaggcagtttgtctttacacatttatcttgcaaaccattctgacttgttaaacatgtactgaaaataaacttccgatggtagcgatggtttgtgctgagaccatgtgcttcatcagggagggacacagcagtgtatctatttttgcttcttcttttttctctctgggaactagggcggtaggggccccttgtatcgttgtaaccatgcaaaaaattaactggttgacattattatttacattatttgctagttgttattttgataaggtacttgctgggttggacagtaattggatgtgtgtcggtattgatcg

SEQ ID NO: 2869 - DNA, 2459 bp, Panicum virgatum
ggttcgcccagccgcatccacctcctccccctccccctctcacgcccaccaccacaggcacacccaaaccctagctagcaatcccgatcccaccccaacccaatccgccccgcccacaaagtcatgcgagatcacccgacatcctagccccccaaccctagcagatatcagcagatccagatatgagcaccagcctgtccccgcccgactcctcgccgccgccggctgaggtccccctcgccccgggcttccgcttccaccccaccgacgaggagctcgtctcctactacctccgccgccgcgtcctcggccgccgcctccgcgtcgacgccatcgccgaggtcgacctctaccgcctcgagccctgggacctcccctccctctcccgcatccggagccgcgatgcccagtggtacttcttcgcgcgcctcgaccgcaaggtcgccggggccggcgccggcggccggggaggcccggggaacaggaacaaccgcgccacgccgcggggatactggaagaccaccggaaaggaccgcgaggtctaccaccgcggcaagcccgtcgggatgaagaagacgctcgtcttccacgccggcagggcgcccaagggggagaggagcaactgggtcatgcacgagtaccgactccttgacgccgacgggccccaggatctgcacgtggtgtgtaggatcttccagaagcatggttctggaccacagaatggagcacagtatggtgcaccatacatggaagaggaatgggaggaagaagatgatgctattgagaatgcacctgctagtggcacatctgctggaatggctacaatcacatgtgctgcggatgaggagtcgaatgaggaggatgagaatggatattgtaaaaccaatgagcttgctcaggcccatggaatgctcagctctccagagatggcccctctcaaagctcaaggttccaaagacaccagtgaaggaagctgtgctgacggtgttatttctctggaggagattatgcaggaacccttgtctgcagagaacataggtagatctgaagggcagaatgccactgatgataacttcagtgttgacgacttattatctgcatgcccaacgaaagataatgactatgtaggtcaggatggcactctgaatgggagttacccagcagatggcgattgcacacattggcctttgagggcatatagtaatcagaattatgccaatggtactcttagtgctgaggagttctttgacacacagaatgatagcaatgggaatacatattcagagtaccagcaggctgatggctttccagcacctcaccaagtggatggcagtatggtattttacgatgctccatctgattacaacttggtggatggaaatgatgactttgtatatttgaacgacctcctcaatgagccgcttggaaatgaatcactctttgatggagatgatatgatggcttactttgatgccacggagaatgatttcaagtatgatattttgggttctgcgcagggttcaaattatcaacttgcagacatgccattgaacttttcccaaaagggtgataacaaggacaagtttacacttgatgggatctcaaagtcttcggaagaaaatactcaatacggtgcgtcttcatctggttcccacaaggatctgtatccagatactgcaataccagatgacaccgttgataaaactttcggaaagcgccttgccagcatgttgggctctatcccggctccacctgcaatggcatcagaaccgtcagcgactggaaaatctgttggcgctctctcggctgtcagcccgagctcgattcgtgttacggctggcatcatccaactcgatggcctcacttttactggtgtctctgagcggtggcccctgcagaagaatggagacttcagtttgcttctgtctttcaccgtggagagcgatgtgccatccaagcctgttggttttgagcaggctacacggatgagtaccatccccatggtgctgcgcagcggcatgtatcttttctttgtatcagccatgattcttctgttgagctacaaagtagggtcgtgtatctacagcaggtaagttaatgtggccccgttccgtctgagggctgttacatttgatttggaacgtgtcccctcaacgagggtataacaatggagacagtttgtctttgaacatttatcttgcaaaccattctgacttgttaaacatgtactgaaaaaaaataaacttccgatggtagcgatggttcgtgctgaaaccatgtgcttcatcaggaagggacacagcagtgtatctatttttttcttccttttttttactctgggagctagggcggtaggggcccttgtatcgttgtaaccatgcagaaaaattaactggttaacattattatttacattatttgctagttattttgataaggtacttgctgggttggacact

SEQ ID NO: 2870 - DNA, 2538 bp, Panicum virgatum
aagcaggcaactaccacaccgcggcggcggaccctcttcttctcttcgtctccctcacgccaaagccaaagacttgggttggttcgcccagccgcatccacctcctccccctccccctctcacgcccaccaccacaggcacacccaaaccctagctagcaatcccgatcccaccccaacccaatccgccccgcccacaaagtcatgcgagatcacccgacatcctaggccccccaaccctagcagatatcagcagatccagatatgagcaccagcctgtccccgcccgactcctcgccgccgccggctgaggtccccctcgccccgggcttccgcttccaccccaccgacgaggagctcgtctcctactacctccgccgccgcgtcctcggccgccgcctccgcgtcgacgccatcgccgaggtcgacctctaccgcctcgagccctgggacctcccctccctctcccgcatccggagccgcgatgcccagtggtacttcttcgcgcgcctcgaccgcaaggtcgccggggccggcgccggcggccggggaggcccggggaacaggaccaaccgcgccacgccgcggggatactggaagaccaccggaaaggaccgcgaggtctaccaccgcggcaagcccgtcgggatgaagaagacgctcgtcttccacgccggcagggcgcccaagggggacaggagcaattgggtcatgcacgagtaccgactccttgacgccgacgggccccaggatctgcacgtggtgtgtaggatcttccagaagcatggttctggaccacagaatggagcacagtatggtgcaccatacatggaagaggaatgggaggaagaagatgatgctattgagaatgcacctgctagtggcacatctgctggaatggctacaaccacatgtgctgcggatgaggagtcgaatgaggaggatgagaatggatattgtaaaaccaatgagcttgctcaggcccatggaatgctcagctctccagagatggcccctctcaaagctcaaggttccaaagacaccagtgaaggaagctgtgctgacggtgttatttctctggaggagattatgcaggaacccttgtctgcagagaacataggtagatctgaagggcagaatgccactgatgataacttcagtgttgacgacttattatctgcatgcccaacgaaagataatgactatgtaggtcaggatggcactctgaatggaagttacccagcagatggcgattgcacacattggcctttgagggcatatagtaatcagaattatgccaatggtactcttagtgctgaggggttctttgacacacagaatgatagcaatgggaatacatattcagagtaccaacaggctgatggctttccagcacctcaccaagtggatggcagtatggtattttacgatgctccatctgattacaacttggtggatggaaatgatgactttgtatatttgaacgacctcctcaatgagccgcttggaaatgaatcactctttgatggagatgatatgatggcttactttgatgccacggagaatgatttcaagtatgatattttgggttctgcgcagggttcaaattatcaacttgcagacatgccattgaacttttcccaaaagggtgataacaaggacaagtttacacttgatgggatctcaaagtcttcggaagaaaatactcaatacagtgcgtcttcatctggttcccacaaggatctgtatccagatactgcaataccagatgacaccgttgataaaactttcggaaagcgccttgccagcatgttgggctctatcccggctccacctgcaatggcatcagaaccgtcagcgactggaaaatctgttggcgctctctcggctgtcagcccgagctcgattcgtgttacggctggcatcatccaactcgatggcctcacttttactggtgtctctgagcggtggcccctgcagaagaatggagacttcagtttgcttctgtctttcaccgtggagagcgatgtgccatccaagcctgttggttttgagcaggctacacggatgagtaccatccccatggtgctgcgcagcggcatgtatcttttctttgtatcagccatgattcttctgttgagctacaaagtagggtcgtgtatctacagcaggtaagttaatgtggccccgttccgtctgagggctgttacatttgatttggaacgtgtcccctcaacgagggtataacaatggagacaatttgtctttgaacatttatcttgcaaaccattctgacttgttaaacatgtactgaaaaaaaataaacttccgatggtagtgatggttcgtgctgaaaccatgtgcttcatcaggaagggacacagcagtgtatctatttttttcctttttttactctgggagctagggcggtaggggcccttgtatcgttgtaaccttgcagaaaaattaactggttaacattattatttacattatttgctagttattttgataaggtacttgctgggttggacactaa

SEQ ID NO: 2871 - DNA, 2728 bp, Setaria italica
gagacgcggttgcacgggcaccaggcccacctcttcttgcttccttcgtggggtggttggtcgtctccctcctcacgccgacgccaaaccaaaaaagcgcctaccaccagcgacttcaacctcctcctcctcaatcgcccgcccgccttgtgttcgccgcctccacctcacccccaagcctcctccctcccacgccacccccaaaccctagcaacccgatcggacccaacccgatccgcccaccaaaaaaaaatcatgcgagattccccggcatcctagcccaaccctagcagcagatccatcaccaccaaccccctagagatgagcagcctatcacctctcgactcctcgccggcggccgaggtgcccctcgcccccggcttccgcttccaccccaccgacgaggagctcgtctcctactacctccgccgccgcgtcctcggccgccgcctccgcgtcgacgccatcgccgaggtcgatctctaccgcctcgagccctgggacctcccctccctctcccgcatccgcagccgcgacgcccagtggtacttcttcgcccacctcgaccgcaagatcgccggggccggcgccggcggccggggaggccccggcaacaggaccaaccgcgccacgccgcggggctactggaagaccaccggcaaggaccgtgaggtctaccaccgcggcaaggccgtcgggatgaagaagacgctcgtcttccacgccggcagggcgcccaagggggagaggagcaactgggtcatgcacgagtaccgactcctcgatgcggacgggccccaggatctgcacgtggtgtgtagaatcttccagaagcatggttctggaccacagaatggagcgcagtatggtgcaccatacatggaagaggaatgggaagaagaagaagatgccatcgagaatgcacctgttagtggcgcatctgctggaatggctgcaatcacatgtgctgtagatgaggagtcgaatgaggaggatgagaatggatactgtaaaatcaatgagcttgctcaagcccatgaagactcaccagagatggctcctctacaagctcaaggttccaaagacaccagtgacggaagctgtgctgatggtgttatttctctggaggagattttacaggaacctttatcaaatattaatgcagagaatataggtagctctgaagggcagaatgccactgatgataacttcagtgttgatgacttattatccacatgccccacaaaagatgatggctatgtaggtcaggatggcactctgaatggtagttacccggaggatggcaatcacacaaattggcctttgagagcatatagtaatcagaactatgccaatggtactcttagtgctgaggagttctttgacacacagaatgataccaatgggaatgcatattcagagtacccgcaggctgatggctttccagtacctcaccaacaagtggatggcagcatggtattttacgatgctccgtctgattacaacttggtggatggaaacgatgactttgtatatttgaacgacctcctcaatgagccgcttggaaatgaatcactctttgacggagatgatatgatggcttactttgatgccacggagaatgatttcaagtatgatatttcgggttctgccaagagttcaaactatcaatttgcagagatgtcaacgaactttgcccaaaagggtgataacaaggtcggatttacattcgatgggatcgccaaggcttcggaagcaaatgttcaatacagtgcgtcttcatctggttcccatgaggatctgtatccagattctgcagtaccagatgacgacactggtgataaaacttttggaaagcgctttgccggcatgttgggctctatcccagctccacctgcaatggcctcagaattccctccggcgaccggaaaatctgttggcgtgctctcggctgtcagcccgagctcgattcgtgttacggctggcatcatccaacttgatggcctcagttttactggcgcctccgagcggtggcccctgcagaagaatggagacttcagtttgcttctgtccttcacagtggagagcgacatgtcaaccaaagctgcttgtttcgagcaggcttcacggatgagcaccatcccaatggtgctgcgcagcggcatgtatcttttctttgtctcggccatgatacttgtgttgagctacaaaatagggtcgtgtatctacagcaggtaagttaatgctgccccggcgtccggccgagggctgtttatttgattattatccatcctccctcaactagcagggaggcgcatttagcttgcaaaccatcctgacctgttaaacatgtactggcaataaacttgcgatgggagcgatgtacgtcatggattgtgccgcctcatccgggacacagcagagtatctgttttcgtttgcttttcccttcttttttaatttgttatatatggtgggagctaggggcccttattatcattgtaaccatgcggatttaactggtgtattatttgcttggttggtagacggccattgaccgtgtgtccttatgattgtgagtggggtgattctgtgggctgtcaaagagctaggtccgacgacctaaatttagaccttggattattcaggcaggcatgtatgtattttcctcgtatagacgcatgtaaagttcatagaatggtgaagtgaatcatgaaatcgcgctcgct

SEQ ID NO: 2872 - DNA, 2186 bp, Zea mays
gtatccagtcagatcttcctcctcccaaatccatcgctagccagcctgctgctagcacgcacagtaccacacagtacgtgctcaaataatgctcgctcctggcctcctgctaccaaggaccaagaaaaggagggccggcgaggacgtctggccgtctgggtccctatatatgagacagcgaggaggtgggtgtgaaggctgtgcccagtgagctcagctcgatccatcgatcggagagcttttgcactgcaccagctctgaagccatggctgctgcttcttcctccatggacaggatcgcccagtgggtgtcgtcccaggaggtcccgaccgacctcaccgtccgcatcgccgactccgtcttctctctccacaaggcggtgatggtgcccaagtgcggctacatccgccgggccgtggcggcgagccagacgcagggcccggggggcggcgccgtcgagctggacctctccgcgctgccgggcggcgctgacgccttccagaaggcggcgcgctgctgctacggcgacagcctcgagatcacggcgcgcgacgcggcggcactccgctgcgccgcggagttcctcgacgcgccggacctggcccgccgcgccgacgacttcctcgcgcaggccgcgctgcgcgcgctccccggcgccgccgccgtcctgcggtcctgcgaggcgctgctcccggccgccgacgagctcggcgtcgcgcgccgcgccgcggacgccgtcgcgctcggggtctgcaacgaggcgctgttcccgacgccgcgggcgccgcccgggtggtgggcggccgagctggcggcgctgtcgccggcgtcgttccggagggtggtcgcggcgctgcggtgccgccgggccgggcccgaggtggtggccgccgcggccgccgcgtacgcggagcgcgtcctggccggggtcctcgcggcgcccggccgccgggacgcggaccagcgcgcgctgctggaggccgtcgtggacgcgctgcctcccgccgccgacgcgcccctcccggccgccttcctctgccgcctcctccgcgccgcggtcaccgccgaggcgtccgccaagacgtgccgcgacatggagctccgcgtcgcggccgtgctggaccaggccaccgcgggggacctgctgggcgtcgcgctcgacggcgccggggagcgcgtcgtcaacgcggacaccgtccgccgcgtcgtcgccgcgtgcgtcgagcgccagcagacgcagcagggccggcgggcgtccctggccggaggtccggcaggtgagctcagcgcgctggagaaggtggcgaagacggtggatgaggtggcggcggagatggcgtcgcacgagtcgctgcctatctccaagttcgtgggcgtggcgggcgcggtgcccagggacgcgcgcccgtcgcacgactgcctgtaccgcgccgtggacatctacctcaagacacacccggggctggacgagatcgagcgggagaaggtgtgcagcgtcatggacccgctcaggctgtcgtaccaggcgcggatgcacgcgtcgcagaacaagcggctgccgctgcaggccgtgctcagcgtgctctactacgaccagctgaagatccgtagcgcggacggcagcggcggcacggaggaagggtgggagacacagtcggccgccgggaaggcccgtgcgcaggcgcgggcggacgtgtcgctggcaagggagaacgaggcgctgcggttggagctggcgcggatgcgagcgtacgtgtcagggatgcagcagagcagcaaggggagcgggtcgaggccatcgtcgtcatcgctggtaccaggcccagcgacggcgacggggaagaaggcaagcttcttagggtcggtgtcgcggacgttgagccggctgaacccgtttaagggcgggtgggccaaggacacgaccagcattgccgatgggcgtgacaggacttccatgcatgtggtgaagcccaagaggaggaggttctccatcggctaattcttttgtgatatatcgatatgatcgtgtcatcgtgtgtgtgacttatattaaatcactgtgattagaggctagaacaaggggtgtggatgtttgtactttctctgtcaatgaaaaaacaatatgcactacaaaggcaaaagtgtaggttaaaatagtggactaaggagtaaatattaatagtact

SEQ ID NO: 2873 - DNA, 607 bp, Zea mays
aaacaagcagcagcagagcagaggatggcaatggaccacgtggcgaggctggcgtcggagcgcgcggtggtggtgttcacggcgagcaactgcagcatgggcgacgtggtgacgtcgctgctgagcagcctgggcgtcaacgcggcggtgcacgacctggacagggacccccggggcatggagatggagcgggagctggccaggaggctcggcggcggcggcgggcgcggcacgacgacgacccctaccgtgccggcggtgttcgtgggcggtgacctcgtcggcgggaccaacagggtcatggctctgcacctctccggcgagctcgtgcccatgctcaggaaagccggcgccctctggttgtagtaaattgagaacgcccgccgatcgaccgcgcgcatgcaagcatggctgatgagctttttacatcagctgtgtgtatatgtatgtgaataaaaaagaagcggtcaaagacggcaaagagatggagagagaaggatccacgtactaagagtacgtgatgaacgcgaggttttgtcgttgtgtcctccttggaataaatgtcacctccgttttcactcgtcaaaatgttagctttatgctgatc

SEQ ID NO: 2874 - DNA, 667 bp, Setaria italica
aacttttgcagaccatctacaactctaaagagggacgagtctagaaccttccggggcaccagaccattgaagtgatggaccgcgttgcgaggctggtgtcggagcgggcggtggtggtgttcacggcgagcaactgcagcatgtgcgacgtcgtgacgtcgctgctgggcagcctgggcgtgaacgctgccgtgcacgatctggacagggacccccggggccgggagatggagcgggagctcgccaggaggctgggcggcggctccgggcccggtggcagcacaccgaccgtgccggcggtgttcgtgggcggcgacctcgtcggtgggaccaacagggtcatggcgctgcacctcgccggcgagctcgtgcccatgctcaggaacgccggcgcgctctggctgtagagaaattgatcgagaacgtccaagcgcgtgcatggcatgcacacgcgtacgttcatgcatgtcgtcttagctttatcgtcagtcagatgtgtatactataaaataaaaaaagatggtaggaaggagatagggagagatgtagaagtgtgcgtgaatgccaggttttttgtgtcctgtgcttggaatatagataagtatttcatcaaaatggtgagcaatgttattttttaaactttgttattcaaactttgatctatgta

SEQ ID NO: 2875 - DNA, 653 bp, Panicum virgatum
accttttcaaatcatctgcaactctaattaaggagagacgctagctagctagctgtgctgtgtctactctagaaccctctagaagcttccattggatcgagatcgatggaccgcgtggcgaggctggcgtcggagcgggcggtggtggtgttcacggcgagcaactgcagcatgtgcgacgtggtgccgtcgttgctgggcagcctgggcgtgaacgccgccgtgcacgagctggacagggacccacgcggcgggagatggagcgggagctcgccaggaggctcggcgccggcgccgtgcacggcggcggcacatggcacacccaccgtgccggcggtgttcgtgggcggcgacctcgtcggcggcaccaacagggtcatggcgctccacctcgccggcgagctcgtgcccatgctcaggaacgccggcgcgctctggctctaggagctcagaccacgccggcagcgcacatgcagccatgcacgcgcgtgcaagcatatcttagcttttttttttcgtcagacgtgtacgagtgcgtgaatgccaggtttttttgtatcctgtgcttggaataagtcaaataaatatggcatcagtattaacatgattttcgatatatatttatattaatactactattcgatgtttgatcg

SEQ ID NO: 2876 - DNA, 1040 bp, Panicum virgatum
tttgttttttcagatttaagcactggaaatttcggatgaggtcaactcgagtcatgaggaaagattccaacgatccaatggcttcttatccaaaactatccaatctttaacccgcactcgatcagaagaatcatttttcaggtatgcaagaaccaaatctagctttacatgttcgatatgtacatacaaatataacatgtttagcagatgctgtcagttggttgccaagaatcttataatgatccactgcaagtaggtactacgtgccaacatcttttccagcctataaaaggaagccatggccagcaccaagaaaccacaccagtcaactttttcaaatcatctgcaactctaaggagacagtacactagctagctgtgctgatcgagtctagaacactctagaaggttccattggatcgacgatggaccgcgtggcgaggctggtgtcggagcgggcggtggtggtgttcacggcgagcaactgcagcatgtgcgacgtggtgacgtcgctgctgggcagcctgggcgtgaacgcggccgtgcacgagctggacagggacccccgcggccgggagatggagcgggagctcgccaggaggctcggcgccggcgccgccggtgccgtgcgcggcggcgtcacacccaccgtgccggcggtgttcgtgggcggcgacctcgtcggcggcaccaacagggtcatggcgctgcacctcgccggcgagctcgtgcccatgctcaggaacgccggcgcgctctggctctaggagctcagaacgccggcggcgctcatgcaaagcatgtcttagctttttttcgtcagacgtgtacgagtgcgtgaatgccaggttttttttgtatcctgtgcttgtaataagtcaaataaatatcgcatcagtattaaacatgattttcgatatctattactttaatactattcgatctttgatcggtatatttttcttttacagaaatactacatgtgtattaatgtatggtcgtcgtatggatactgatcgagtgattattgcaaatgtataa

SEQ ID NO: 2877 - DNA, 715 bp, Sorghum bicolor
caagaaaccacatcgatcagccaaccattaatttccaagctaacaacgaaacccagaacccttccaggcagcgccacagccataatcagcaacctgatcaaaagctgccagtgccaatggaccgtatggcgaagctggcgtcggagcgcgcggtggtggtgttcacggcgagcaactgcagcatgggcgacgtcgtggcgtcgctcctgaacagcctgggcgtgaacgcggccgtgcacgacctggacagggacccccggggccaggagatggagcgggagctcgccagcaggctcggcgccggcgccggcgggcgcggaagccccgctgtgccggcggtgttcgtgggcggccacctcgtcggcgggaccagcagggtcatggcgttgcacctcgccggcgagctcgtgcccatgctcaagagcgccggcgcgctctggctataggatggatcgagcagacgacgagaacgcgcacacgcatgcaggcatcgctagcttttctttccctcatatagtatacatgatggatgaggacatgcatgtcaagaacgaagaaaaggtcgatgtagaagagtgtgcgtgcgtgaatggcagttttttttatgcctaacgctgatatatataacaactgtttaaatgtacaatgtttccaatgctttcatcattaggtcgatgaaaactcatcagttgtaccaatctgatttcaatgcaaa

SEQ ID NO: 2878 - DNA, 392 bp, Setaria italica
cggcaatggagcgggtggcggcgctggcgtcggagcgggcggtggtggtgttcacagcgagcaactgcagcatgggcaacgtcgtggtctcgctgctgagcagcctgggcgtgaacgccgccgtgcacgaggtggacagggacccccgcggccgggagatggagcaggatctcgccaggaggctcgccggcagcagcggcggcacacccaccgtgccggcggtgttcgtgggcggcaaccttgtcggagggacggccagggtcatggcgctgcacctcgccggcgagctcgtgcccttgctcaggagcgccggcgcgctctggctgtaggatcacggagcgagcgacgacgacgtgcatgaacgcgttgcatgcgcatgcaacgatagcttt

SEQ ID NO: 2879 - DNA, 1324 bp, Saccharum officinarum
cacgagctgttgcacacgtacccgttcttgctgcgcgcttgctcgctccactgccctccactcccactacctaccactcacgccccgccacccggccgtcactcctcctcggatccattcggcgatggagaagatgctccacgcagcccccgtccacgcgacgctcccggagtgcttcatcttcccggccgacaagctcccgcaagccaaagccacctccgccacggtctcgctgcccatcatcgacctgtccctgggccgcgacgaggtgcggcgcgccatcctggacgccggcaaggagatcggcttcttccaggtggtgaaccacggcgtctccttggaggcgatgcgggacatggaggcggcgtgccaggagttcttcgcgctcccggcggaggacaaagccgggctctactccgaggacacggggaagaccacccggatctactccagcaccatgttcgacacgggcgccgagaagtactggcgcgactgcctccgcctcgcctgctccttccccgacgtcggcgacagccccaagaactggcctgacaagccggcgaggctccgggaggtcgtggagaggttcacggtgcagacgcgggggctcgggatgcagatcctgcgcctgctctgcgagggcctcggcctccgccccgactacctggagggggacatcagcggcggcgacgtggtcctccacgtcaaccactacccgccgtgccccgacccgaccgccacgctcggcctgccgccgcactgcgaccgcaacctcctcaccttgctcctccccagcatggtccgtggcctcgaggtcgcctacagtggcgactggatcaaggtggaccccgtgcccggcgccttcgtcgtcaacttcggatgccaacttgaggttgtgacgaatggggtgctgaagagcatcgagcaccgggtgatgaccaacctgggggtggcgcggacgacggtggccacgttcatcatgcccaccacggactgcctcatcggccccgccgccgagttcctcagcgacgacaacccgccggcctaccgcacgctcacgttcggcgagttcaagcgcatctacagcgtcgtcaagctggggtcgtcgctcaacctcaccaccaatctcaaggacgtgcagaaggagctctgatgaaggagtatgcaaccaaataaaaatcccagattagccatgcatcgatcacatgcagctagctagcttggaagatgtattgtagcctgtattatgttcactgctacccggacgtcatgctgatgatatgaagcaataaataaaaatgacaaattaataaaaaaaaacaaa

SEQ ID NO: 2880 - DNA, 1285 bp, Setaria italica
gtgcgtatcttgctgaaagtaggctgcacctctgctctcccgggcttctccggttcaaccatggacaagatgctccactcagccccgatccacaccaacctcccggactgcttcgtcttcccagccgacaagcgcccaccggcgaccgccgccgtcgtctccctgcccatcatcgacctgtcccgcagccgcgacgaggtccgccgtgctatcctcgacgccggcaaggagatcggcttcttccaggtggtcaaccatggcgtctctgagcaggcgatgcaggacatggaggccgtgtgccaggagttcttccagctgccggcggcggagaaggcggagctctactcggaagacacccagaaggccacccggatctactccagcaccatgttcgagaccggcggcgagaggtactggcgagactgcctccgccttgcttgctccttccccgtcgccgacagccccatggcatggccggacaagccccagaggctccgggaggttgttgagaagttcaccgtgcagacgaggggcatggggatggagatactgcggctgctgtgcgagggcctggggctccggcacgactacctggagggtgacatcagcggcggcgacgtggtcctccacgtcaaccactacccgccgtgcccggacccgagcacgacgctcggcctgccgccgcactgcgacaggaacctcctcaccttgctcctcccaagcatggtccctggcctcgaggtcgcctactatggcgactggatcaaggtccagcccgtgcccaacgccttcgtcgtcaacttcggctgccaacttgaggttgtgaccaatgggcttttgaagagtatagaacaccgtgtggtgaccaacttgggggtggcgaggacgaccgtggcgacgttcatcatgcccaccacagactgccttatcggccccgcggaggagttcctcagcgaggacaacccgccgtgctaccgcaccctcacgttcggcgagttcaagcgcatctatagtgttgtcaaactagggtcgtcgctcaatctcaccacgaacctcaagaacgttcagaaggagacatgaagcaagagcacaagtgattcaggatgttgtcgatcttttatccgttcccaattcccatgtgtctgcagaggacatggatctcagttacatgctgctgctgggagcgtaatgtgcacttcagcacttgtcctgttatgacaataaaaatgacaaataagtgactgtatacatgagagggagatatatgtgcatggcttgttcttgc

SEQ ID NO: 2881 - DNA, 1247 bp, Cenchrus ciliaris
  misc_feature (136)..(136): n is a, c, g, or t
  misc_feature (140)..(140): n is a, c, g, or t
  misc_feature (143)..(143): n is a, c, g, or t
  misc_feature (164)..(164): n is a, c, g, or t
  misc_feature (166)..(166): n is a, c, g, or t
  misc_feature (171)..(172): n is a, c, g, or t
  misc_feature (177)..(177): n is a, c, g, or t
  misc_feature (179)..(180): n is a, c, g, or t
  misc_feature (182)..(182): n is a, c, g, or t
  misc_feature (184)..(184): n is a, c, g, or t
  misc_feature (254)..(254): n is a, c, g, or t
  misc_feature (257)..(257): n is a, c, g, or t
  misc_feature (266)..(266): n is a, c, g, or t
  misc_feature (290)..(290): n is a, c, g, or t
  misc_feature (299)..(299): n is a, c, g, or t
  misc_feature (314)..(314): n is a, c, g, or t
  misc_feature (335)..(335): n is a, c, g, or t
  misc_feature (569)..(569): n is a, c, g, or t
  misc_feature (653)..(653): n is a, c, g, or t
  misc_feature (755)..(755): n is a, c, g, or t
  misc_feature (776)..(776): n is a, c, g, or t
  misc_feature (825)..(825): n is a, c, g, or t
  misc_feature (904)..(904): n is a, c, g, or t
  misc_feature (953)..(953): n is a, c, g, or t
  misc_feature (1065)..(1065): n is a, c, g, or t
  misc_feature (1069)..(1070): n is a, c, g, or t
  misc_feature (1133)..(1133): n is a, c, g, or t
  misc_feature (1138)..(1139): n is a, c, g, or t
ctctctgctctccggcgtgctgcgtgctctcccgttgttcaaccatggagaagatgctccactcagctccggtccacaccaacctcccggactgcttcgtcttcccggccgacaagcgcccaccggcgagcgccgncgtngtntccctgcccatcatcgacatntncctcnnccgcnannangnccgccgtgccatcctcgacgccggcaaggagatcggcttcttccaggtggtcaaccatggcgtctccgancangtgatgcangagatggaggcggtgtgccagganttcttccanctgccggcggcgganaaggcggcgctctactcggangacacgcagaaggcgacccggatctactccagcaccatgttcgagaccggcggcgagaggtactggcgcgactgcctccgcctcgcgtgctccttccccgacgtcggcgacagcgccgcggcgtggccggacaagcccccgcggctccgcgaggtcgtcgagaggttcaccgtgcagacgagggccatggggatggagatactccggctgctctgcgagggcctgggcctccgncgcgactacctggacggcgacatcagcggcggcgacgtggtgctccacgtcaaccactacccgccgtgcccggacccgagcgcnacgctcggcctgccgccgcactgcgacaggaacctcctcaccttgctcctccccagcatggtccccggcctcgaggtcgcctacaatggcgactggatcaangtccagcccgtgcccaacgcnttcgtcgtcaacttcggctgccagctcgaggtggtgaccaatgggcttntgaagagcatagagcaccgtgtggtgaccaacttgggggtggcgaggacgacggtggcgacgttcatcatgccgacggnggactgcctcatcggcccggccgaggagttcctcggcgacgacaacccnccgtgctaccgcacactgaccttcggcgagttcaagcgcatctacagcgtcgtcaagctggggtcgtcgctcaacctcaccacgaacctcaagaacgtccagaaggagacangaanngaagcaaagtagttcaggatgtacgttgtcgatcttttatccgttcccaaatcccaaatctcntgtcnntcgctgcagaggacatggatctcagttacatgttcatgctgggaagtagttaagtaatgtgttgtcatgcttaagacaataaaaatgacaaataagtgactttatata

SEQ ID NO: 2882 - DNA, 2429 bp, Zea mays
ctgttggcagggtccggttcacgccgcggcggctcgactggactcccctcgtcatggccggcgtcagcggccgcggggccgcggagagggtggccgccgccgtggaggcggtgggatccggtggctgggagttccgaaacgcgtacaggcgccagctgctcgcgctgtcgcggcggatccggctccttggcccctttgtcgaggagctccgggaggtaccctgtgtacccgcggtggaaccggagcgggcgctggcggtgctcgccgacgcgctggaggaggcgctcgacctgctccagctcggccgcgacgggagcaggatattcctggtccttgatagggataaagtaatgaagaagtttcatgaatcaattgttcagctggagcaagctttgtgtgatttttcatatgataaattggacatatctgatgaagttagagagcaggttgagttagtgcatgtacagctcaaaagagccaaagaacgggttgacatgcctgatgatgagttctacaatgaattactttcactgtataacaagagccacgacccaagtgctgaattggatatccttggaagattgtcagaaaagctgcacctgacgaccatcaccgatctcacacaagaatcgcttgctttgcatgagatggtggcatccggtggcggtaatgatcctggagaacacattgaaaaaatgtcgatgctactgaagaagatcaaggactttgtgcaaactcagaaccctgaaatgggcccgccgatgactaccaagctaatggatcccaatggggagccaagacccagaaacatccctgatgagttccggtgtccaatttctcttgagctgatgaaagaccccgttattgttgctactggccagacatatgagcgggcattcatcgagaaatggctagcttctgggcaccagacttgtccaaatactcaacagaggatgccaaacacaacactgacaccaaactatgttcttagaagccttattgcacagtggtgcgaggccaacgggatcgatccaccgaagcgctcgacgcagcctgacaaacctacatcttcgtgctcttcgagcgaacgtgctaacatcgacgctcttctctccaagttatgctccgcagatcctgaggaacagagatcagctgctgcggagctccggctcctggcaaagcggaatgcaaacaatcgtatctgcattgcctaggctggtgccattcccttaatattgagtctcctgtcgtcatctaatctgcagacccaggaacgtgctgtgactgcacttctgaacctctctagacacgaagataacaagactagcatcatttcatccggtgccgtcccgggcatagttcatgtcttgaagaatggaagcatggaggcacgggagaatgccgcagccacccttttcagcctgtctgtggtcgatgaatacaaggtaacaatcggaggaacaggagccatccccgctcttgtagttttgctgagtgagggcagccaacgcgggaagaaggatgcagcagccgccctgttcaacctgtgtatctaccaggggaacaagggccgtgccatacgagctggcctggtgccactcatcatggggctcgtgacgaaccccaccggagctctgttggacgaggccatggcgatactctcgatactgtccagtcaccccgagggcaaggccgcgattggggcggccgagcccgtccccgtgcttgtggagatgatcggaagcgggtcgccgaggaacagagagaatgctgcggctgtgatgctgcatctgtccgtgcagtccgtgcatctagcccgggcgcaggagtgcggcatcatggtcccgctacgggacctggccctgaatggcacggagagggggaggagaaaggcggtgcagctccttgagcgaatgagcagattcctggttcggcaacaagagggtatcagctcccatgagcagatgttggacgagctcgaacgtcaacttgatgccttcggacctggtgttacagaggccgatatccttgaacaatcgggacttctttaacccacggttgcatgatgatgatgaatctatcttcgccataatactatcaaaagaggtcttcttttggggatagtactaccaaaagagttcatgctgaaccagagttctttcatggcgacgttctatcggcactgatgctgatctgtccgtccggtttggcttcttccatgcttgtgtgctgaagctcccatcgctccatcagtttctgggaacgtaaggtagcacagaatgatgagatgtgtacagtctactatgtatgctgctccagacgtcatatagctatgtacattttttttcactatggtactataaaaaatgaggagttttagcggcggacttgatcagtaatacttatttcgtgcatgcgtacttgttggc

SEQ ID NO: 2883 - DNA, 2596 bp, Panicum virgatum
agccgcgacgcgttccgcccggttcacgcggcagccggtcgccacgccatggccggcgacggcgggggcgccgcggagagggtggcggcggccgtcgaggcggcggcggcgggcggctgggatttccggaacgcgtaccggcggcagctcctggcactgtcgcgccggattcggctcctcggacccttcgccgaggagcttcgggaggcgcgccggggccccgcggagaaggagcgggagcgggcgctgagcgccgctcgccgacgcgctggagaaggcgctcgacctgctccggctcggccgcgacgggagcaggatcttcctggtccttgagagggataatgtaatgaagaagtttcaaggagtaattgctcagctagagcaagctttgtgtgattttccatatgataaattggatatatcagatgaagttagagaacaggttgagttagtgcatgcacagctcagaagagcaaaagaacgggcagacatgcctgatgatgagttctacaatgacgtactgtctctgtataacaagagctatgacccaagtgctgaactggatatccttgaaagattgtcagaaaagttacacctgatgaccatcactgatctcacacaagaatcacttgctttgcatgagatggtggcatctggtggtggtcaggatccaggagaacacattgagaaaatgtcaatgctattgaagaagatcaaggactttgtgcaaactcaaaaccctgagatggggccgccaataggtaccaagctaatggattccaacggggagccaaggcctgtaaacattcctgatgagttccggtgtccaatttctcttgagctaatgaaagatcctgttattgttgctactggccagacatatgagcgggcatgcatcgagaagtggctagcttctgggcaccatacttgtccaaatactcagcagaggatgacaaacacaacactgacaccgaactatgttcttagaagtcttattgcccagtggtgcgaggccaacgggattgagccacccaaacgttcatcgcaacctaacaagcctacatcagcatgctcttcgagcgaacgtgctaacatcgatgctcttctgtcccaattatgctctcatgatcctgaggagcagaggtcagctgctgcagaactccggctcctagcaaagcggaatgcaaacaacaggatttgcattgctgaggctggtgccattcccttactactgagtctcttatcttcatctgacctgcggactcaagaacatgctgtgactgcacttctgaacctctccatacacgaggataataaggcaagcatcatttcctcaggtgctgtgccgagcatagttcatgttctgaagaatggcagcatgcaagcacgggagaatgctgcagctacacttttcagcctctcagtgatcgatgaatacaaagtaacaattgggggaacaggggctatccctgcccttgtagttcttttaagtgagggcagccaacggggaaagaaagacgcagcagcagctctattcaacctttgcatttatcaagggaacaagggtcgtgcaatacgagctggccttgtgccgctcatcatggggctggtgacaaaccccacaggagctcttatggatgaggctatggcaatactgtcgatattgtccagccaccctgaggggaaggcggctattggcgcagcggagcctgttcctgttcttgtggagatgattggaagcgggtcaccaaggaatagagagaatgctgcagctgtgatgttgcatctttgcagtggtgagcaacaacgtgtgcatttggcccgtgcacaagagtgcagcatcatggtcccgctacgggagctgaccctgaacggcacggagaggggaaagagaaaggcggtgctgctgcttgagcgaatgagcagattcctggttcagcaacaagaggaaaaggaagcccagctgctggcatccgcacaggccattcctcggatcccggaacaggtccaagagaccgacatccctgaacaattggacagcccttcacctcaatatcccgcagttgcatgatgatgaatgaatatatttgcaacaatactgcaaaaaggttgggcaagcagtatctgagtcacttggcttctagattcatgattcatatactgattgagagtttttaagctgtcagagtcacttctaatcggtgatgatcccagacgcttcatcccatgcttggttgctgaagctcccatcgcaccacctgtttctgggtatgtaaattatcccagaatgttaagatgtgtacagtctagtaaagatgttgctccagatgtcatgtagctattactagtatatgtacattttcactatgacactatataaaagagaagttatagcggcggacataatatcagtaaatcttgttggttgctactgcatgttgccgtgagtttcaagtttcagaacttttatggtgacccctatgcaatgtaatttcaatactggtaagatatggcattataacctacgtcagtgttagttgcattgtaagcagaaggccgtttcatgccatccttgaaatatgggaactttactcgc

SEQ ID NO: 2884 - DNA, 3647 bp, Panicum virgatum
cctaccctgccactaccactcccctccctcggtcctaccccccccccccccccagctagccgcgacgcgttccgcccggttcacgcggcagccggtcgccacgccatggccggcgacggcgggggcgccgcggagagggcggcggcggccgtcgaggcggcggcggcgggcggctgggatttccggaacgcgtaccggcggcagctcctggcactgtcgcgccggattcggctcctcggacccttcgccgaggagcttcgggaggcgcgccggggccccgcggagaaggagcgggagcgggcgctggcgccgctcgccgacgcgctggagaaggcgctcgacctgctccggctcggccgcgacgggagcaggatcttcctggtccttgagagggataatgtaatgaagaagtttcaaggagtaattgcccagctggagcaagctttgtgtgattttccatatgataagttggatatatcagatgaagttagagagcaggttgagttagtgcatgcacagctcagaagagcaaaagaacgggcagacatgcctgatgatgagttctacaatgacgtactgtctctgtataacaagagctatgacccaagtgctgaactggatatccttgaaagattgtcagaaaagttacacctgatgaccatcactgatctcacacaagaatcacttgctttgcatgagatggtggcatctggtggtggtcaggatccaggagaacacattgagaaaatgtcaatgctattgaagaagatcaaggactttgtgcaaactcaaaaccctgagatggggccgccaataggtgccaagctaatggattccaatggggagccaagacctgtaaacattcccgaagagttccggtgtccaatttctcttgagctaatgaaagatcctgttattgtttctactggtcagacatatgagcgggcatgcatcgagaagtggctagcttctggtcaccatacttgtccaaatactcagcagaggataacaaacacaacactgacaccaaactatgttcttagaagtcttattgcccagtggtgtgaggccaacgggattgagccacccaaacgttcatcacaacctaacaagcctacatcagcatgctcttcaagcgaacgtgctaacatcgatgctcttctgtcccgattatgctctcatgatcctgaggagcagaggtcagcttctgcagaactccggctcctagcaaagcggaatgcaaacaaccggatttgcattgctgaggctggtgccattcccttactactgagtctcttgtcttcatctgacctgcggactcaagaacatgctgtgactgcacttctgaacctctccatacatgagtataataaggcaagcatcatttcctcaggtgctgtgccgagcatagttcatgttctgaagaatggcagcatggaagcacgggagaatgctgcagctacacttttcagcctctcagtgatcgatgaatacaaagttacaattgggggaacaggggctatccctgcccttgtagttcttttaagtgagggcagccaacgggggaagaaagatgcagcagcagctctattcaacctttgcatttatcaagggaacaagggtcgtgcaatacgagctggtcttgtgccgctcatcatggggctggtgacaaaccccacaggagctcttatggatgaggctatggcaatactgtcgatattgtccagccaccctgaggggaaggcggctattggcgcagcggagcctgttcctgttcttgtggagatgattggaagcgggtcaccaaggaatagagagaatgctgcagctgtgatgttgcatctttgcagtggtgagcaacaacgtgtgcatttggcccgtgcacaagagtgcagcatcatggtcccgctacgggagctgaccctgaacggcacggagaggggaaagagaaaggcggtgctgctgcttgagcgaatgagcagattcctggttcagcaacaagaggaaaaggaagcccagctgctggcatccgcacaggccattcctcggatcccggaacaggtccaagagaccgacatccctgaacaattggacagcccttcacctcaatatcccgcagttgcatgatgatgaatgaatatatttgcaacaatactgcaaaaaggttgggcaagcagtatctgagtcacttggcttctagattcatgattcatatactgattgagagtttttaagctgtcagagtcacttctaatcggtgatgatcccagacgcttcatcccatgcttggttgctgaagctcccatcgcaccacctgtttctgggtatgtaaattatcccagaatgttaagatgtgtacagtctagtaaagatgttgctccagatgtcatgtagctattactagtatatgtacattttcactatgacactatataaaagagaagttatagcggcggacataatatcagtaaatcttgttggttgctactgcatgttgccgtgagtttcaagtttcagaacttttatggtgacccctatgcaatgtaattccaatactggtaagatatggcattataacctacgtcagtgctagttgcattgtaagcagaaggccgtttcatgccctccttgaaatatgggaactttactcatccacgcggaaattgaactgtttcatatcaaattcacggaaagatttctgttcttcgcagattcatcgaacatctccagtgacttttccacaagcagcacatgtagatcgagagcaatacacgcagattcacatgtatgtgtgttccaaccctgcaaatttgtggatttacagcaggtgcatcgagagtgtttcttggagatttggatagagtctcgcttcgggggcgggggaagcatggattcgatagatctatcaaatgactgaacaaacttcttgttgttgctatcttgaacaaaaatatagtgtcttaaaccactttactttagcccatgaattgactctagtttagttcggagcttgtgttgccaaacatggaacaagaagaaccttgctgctgactagtgtggagcatcaactatcaagcatttactgggtatgttcaacgccgtcaggtcacgcagcgagcaaaagccccagcccccaagccatcaggtcacaacactacgagccaaagctgtgaacagtcggctcacacgtcgagccaaaagccgcaagccaacacaaaccatgaggcgaaggcgagccgagccaagtgttcgatgatcgaggagggctgaggcgcacttgagccagtgccccgagccagaagaaaatgagccgtaaagcgagccgatgcagaggtcaatgagccggctcttgctggcgatccaagccatgtttttgagccagaagtggagccatcttggaattcctcatgtctatcaccattctcatcatggtggcttcattcctatacccgattgcggccgaatctttgatagatattgaatatctcctattgttggtaatgtctgtgagcatcaaaataggtagatttgttctgacaagtatgtaaactagaattatcttgatttgatcatatatatgctaatttgttgtacaacagtccttgtatgctactattagatccttagtgctatagttaagcacaaaa

SEQ ID NO: 2885 - DNA, 2611 bp, Setaria italica
cttgccgcgacgcggtccgtggttcacgcggcagcaggtcgcctcgccacgccatggccggcggcggcggcggtggccgggatcgcggggccgccgcggagagggtggcggcggccgtggaggcggcggcgtcgggcggctgggagttccggaacgcgtaccggcgccagctgctggcgctgtcgcgccggattcggctcctcgggcccttcgccgaggagctccgggaggcgcgcgggggagccgcggagggggagcaggagcgggcgctggcgccgctggccgacgcgctggggacggcgctcgacctgctccggctcggccgcgacgggagcaggatcttcctggtccttgagagggacaatataatgaagaagtttcaaggagtaattgctcagttggagcaagctttgtgcgattttccatacagtaaattggatatatcagatgaagttagagagcaggttgagttagtgcatgcacagctcagaagagcaaaagagcgcgcagatatgcccgatgatgagttctacaatgacgtgctgtctctgtataacaagagctatgacccaagtgctgaactggacatccttaaaagattgtcagaaaagttacacctgatgaccatcactgatctcacacaagaatcacttgctttgcatgagatggtggcatctggtggtggtcaggatccaggagaacacattgagaaaatgtccatgctattgaagaaaatcaaggactttgtgcaaattcagaaccctgagatggggccgccaataggtaccaagctaatggattcaaacggggagccaagacctgcaaacattcctgatgagttccgctgtccaatttctcttgagttgatgaaagatcctgttattgtttctactggccagacatatgagcgggtgtgcattgagaagtggctagcttctgggcaccatacttgtccaaatactcagcagaggatggcaaacacgacactgacaccaaactacgttcttagaagtcttattgcccagtggtgcgaggccaacgggattgagccacccaagcgttcatcgcagcctaacaagcctacatcagcatgctcatcgagcgaacgtgctaacatcgatgctcttctgtcccagttatgctctcatgatcctgaggagcagatgtcagctgctgcagagctacgcctcctagcaaagcggaatgcaaacaaccgaatttgcattgctgaggctggtgccattccattactactgagtctcttgtcttcatctgacctgcggactcaagaacatgctgttactgcacttctaaacctctccatacacgaggataataaggcaagcatcatatcctctggtgctgtaccgagcatagttcatgttctgaagaatggcagcatgggggcacgggagaatgctgcagctacgcttttcagcctctcagtgatcgatgaatacaaagtaacaattgggggaacaggggctatccctgcccttgtagttctattaagtgagggcagccagcggggaaagaaagatgcagcagcagctctattcaacctgtgcatttatcaagggaacaagggtcgtgcaatacgagctggccttgtgccgctcatcatggggctggtgaccaaccccacgggagctcttatggatgaggcaatggcaatactctcaatactgtccagccaccctgaggggaaggcggctattggggcagcagagcctgttcctgtgcttgtggagatgatcgggagcgggtcaccgaggaatagagagaatgctgcagctgtgatgttgcatctttgtagtggtgagcagcaacttgtgcatctggcccgtgcacaagagtgcggcatcatggtcccactgcgggagctggccttgaacggcacggagagggggaagagaaaggcagtgcatctgctcgagcgaatgagcagattcctggttcagcagcaagaggaaaaggaagcccagctgctggcatcgacacaggccattcctcagatccctgaacaggtccaagagatcgacatccctgaacaattggacagtccttcatctcaatatcccacggtcgcatgatgacatgaatatcttcacgactatactaccaaaaggttgagcaagtagtgtctgagtcacttggcttccagatccatggttcagcatgctgaacaagagttctttacgctgtcggattcgcttttcaaatcggtgatgatctttctcttcccatgctcgtgtcgtgtgctgaagatcccattgcgccacctgtttctgggtatgtaaattaccagaatgttgagatgtgtacagtctagtaaagatgcagctccaaatgtcatgtagctatgatactactagtatatgtacattttcactatgatactatataaaagagaagttctagcgacggacttaatcagtaaaccttttgcctgctactacatgttgccgtgagtttcaagtttcagaacttttatggtgacctcatatgcatttgcgattccaaccctggcagcaccgcagcacatggtagtctacgtcagtgccacttgcattattgtaagcagaatgccatttcatgccctcagtgaaat

SEQ ID NO: 2886 - DNA, 1279 bp, Zea mays
tctcctgttcctggaggggccgaggagggagttggcaagccgcaaccgcaatgatggcagctgccgggtccaatggcgaaagcaacaggtgccgaagcaggcagtcatcaggcacactggtggagatgagtcagcagagtgagagaatctccgtctccatctccatcctcccgcggataagatcagttcagaggtggacgcgtaagcaccaccacagcccacaggcccctcgtcgccaccgccctataaatcccacggcgcacatcggagtccggcaccgtagcccccgaagacacactccaagaaaccaagaacaccggccacacgcacgcgcgcgcgcaccgacgcacggcaggcgaggccgaggacgaacagacgataaaggaagcaatggctccgtcgctcgcgtcgacggcggggctcccgagctgcgcggcgcggcgcggcggccggtgcgtggcccgccgcgcgtccgcggttgcgactccggcgacggcgacggcgaggacgcactacgaggtgctcggggtcggggccggcgcgagccggtgcgagatcaaggcggcgtaccggcgcctggcgagggaggtgcacccggactgcggcggccgcggcgacgaggggttcatccgcctgcacgccgcgtacgccacgctcgcggaccccgacgagcgcgcgcgctacgaccgcgccgcggcggtccggagccggatcagggcggcgccgtcggggtccggggcggggttccggccgcggaggtgggagacggaccagtgctggtagcaccgtagcagcagccacgtagacgtagctgcgccggcggtggagtggagtcgccggagcgcgctcggtggtctggtccgttcccagggccagttgcgaccaacgggcccatattgaagacagcccacatgaaaaacggaccgcgatcctggcagcccacatgagttgggatcgtggactttatgggctgcaggcttcgtaggcctttcgcgccagacctggcgctggatgttgttgtaggccatcttgtcttgggatcatagagctgcacgaagaggcatttttaacatctcttttgcactgctgctactccttccactctaaattgtaaaatatttttatctttttattgacatattatgtttactagtatatgtttatatatcgtgtatataattaaaacattgtatctagcgtcttataatttataatgaagagtataaatatatgtgattatattgatatttatacatatatctatgttgttgtttcgacg

SEQ ID NO: 2887 - DNA, 2140 bp, Secale cereale
gctagctagctagtcagccagttacgctgcctaccgctcgacaccgcggcaccactgctcagctcggcagctcggcagctcccttctccctcgcgcgcggcggggcgggggaagatcgaccggccggcgagcgatgtcgagccacgaggcgtgctgcgggaccatgttctgggtgtacctgctctcctgcgcggggctggtgatgttcgcggggctcatgtcggggctcacgctcggcctcatgtcgctcagcctggtggacctggaggtgctggccaaggccggcacgccgcaggaccggcgggacgccgccaggatcctgcccgtcgtcaagaaccagcacctgctcctctgcacgctcctcatcggcaactccctcgccatggaggcgctccccatcttcctcgactccctcgtcccctccttcggcgccatcctcatctccgtcaccctcatcctcgccttcggtgagatcatgccgcaggccatctgcacgcgctacgggctcagcatgggggccaaggcggcgcccatcgtccgggtgctcctcgtcgtcttcttcccggtcgcataccccatcagcaagttgctcgattggctgctgggaaagggccatgttgcacttatgaggagagctgagctaaagacattagttgatatgcacggtgatgcggctggaaaaggtggggagctgactcatgatgaaactactatcattgcaggagcattagagatgactcaaaagactgcaaaagatgccatgactcccatatctgaaactttctcacttgacataaatgccaagctggatgtgcatacagtaggtatgataatgaccaaagggcacagccgtattccaatatactctggaagaccaagcaatattatcggtcttatattggtaaaaaacttgcttacttgccgacctgaggatgaggtgcccactagacatgttactatcagaaaaattccaagggtggctgatgatcttcctctctatgacattctaaatgagtttcagaaaggtcacagccacatggctgtggttgttaaacgcactaaagaagaaggagcatctgctgaaaagaataataacagttttacaccagattacaaaatgaccaacggacatgctcaagctgatggtctgggtctgtcaccctcgcatgtcaacattcccggaggtcgtcgaaataacaatgacaagtacagtaagaaaatcgaaagaaaacgtgataacattcttgattttaacaccgatccacttcctcattattcaatggatgaggaagcggtgggaataattacgatggaagatgtcatggagacactgctgcaggaagatatcttggatgaaacagatgagtatgttgatgtgcataacaagatcaaaataaacatgttaccgccaggcaaaccattgtcacctcttatatctcctagtggtggacctctgtctcaagggctaagaaagacccctatggcttctccgctgtcgccataccataatggcggctccatcttgcgttcccctgttgcaaaccatgctcaatcccctgggactttaccgacgatgctttctcctggaaggtcacccgcgtctcaaactcccgggcgcagttcgccgacttcaagttgggtctcgaggaattcgtaccgaaatccgtagaaatggtggtgagagctaaagccaaagagctcagggggcaataatcccagttgagatcactcccaagatcaaattaaggcactgaagagtacagggtcaaacaatgaagaccccacagctctctcctttgttgctggtccttgtttatttgtgactttcttgtacatatatatatatatgtcccttagcatctgaactgagtatggatgagctctcaccacctactgtagacgccctttttgccaaacttgtagcaaccattgcagaagaaaactgcggagagaaacgacgtaaacgaaacgcgttctgtatgtatcgcgcatctgtgctggtattcttggttgtcagccgccattgtacttactcaaactcaagtaaagcagctgttgttggtgctagcactgctgatggctgcccacatttatgtaagatctgtacaaacttcccagatgaattactgtctaaacttcc

SEQ ID NO: 2888 - DNA, 2177 bp, Secale cereale
cccggagcagagccgcgagcacacaatctagctagcacgctagccagccagttacgctagccagagctcgacaccgcggcaccaccgctcggctcggcagctcggccgtcgtccccttctccctcgcgggaagatcgaccggccggcgagcgatgtcgagccacgaggcgtgctgcgggaccatgttctgggtgtacctgctctcctgcgcggggctggtgatgttcgcggggctcatgtcggggctcacgctcggcctcatgtcgctcagcctcgtcgacctggaggtgctggccaaagccggcacgccgcaggaccggcgggacgccgccagggtcctgcccgtcgtcaagaaccagcacctgctcctctgcacgctcctcatcggcaactccctcgccatggaggcgctccccatcttcctcgactccctcgtcccctccttcggcgccatcctcatctccgtcaccctcatcctcgccttcggtgagatcatgccgcaggccatctgcacgcgctacgggctcagcatgggggccaaggcggcgcccatcgtccgggtgctcctcgtcgtcttcttcccggtcgcataccccatcagcaagttgctggattggctgctgggaaagggccatgttgcacttatgaggagagctgagctaaagacattagttgatatgcacggtgatgcggctggaaaaggtggggagctgactcatgatgaaactactatcattgcaggagcattagagatgactcaaaagactgcaaaagatgccatgactcccatatctgaaaccttctcccttgacataaatgccaagctcgatgtgcatacagtgggtatgataatgaccaaagggcacagccgtattccaatatactctggaagaccaagcaatattatcggtcttatattggtaaaaaacttgcttacttgccgacctgaggatgaggtgcccactagacatgttactatcagaaaaattccaagggtggctgatgatcttcctctctatgacattctaaatgagtttcagaaaggtcacagccacatggctgtggttgttaaacgcactaaagaagaaggagcatctgctgaaaagaataataacagttttacaccagattacaaaatgaccaacggacatgctcaagctgatggtctgggtctgtcaccctcgcatgtcaacattcccggaggtcgtcgaaataacaatgacaagtacagtaagaaaatcgaaagaaaacgggataacattcttgattttaacaccgatccacttcctcattattcaatggatgaggaagcggtgggaataattacgatggaagatgtcatggagacactgctgcaggaagatatcttggatgaaacagatgagtatgttgatgtgcataacaagatcaaaataaacatgttaccgccaggcaaaccattgtcacctcttatatctcctagtggtggacctctgtctcaagggctaagaaagacccctatggcttctccgatgtcaccataccataatggcggcaccatcttgcattcccctgttgcaaaccatgctcgatcccctgggactttaccgacgatgctttctcctggaaggtcacccgcgtctcaaactcccgggcgcagttcgccgacttcaagttgggtctcgaggaattcgtaccgaaatccgtagaaatggtggtgagagctaaagccaaagagctcagggggcaacaatcccagttgagatcactcccaagatcaaattaaggcactgaagagtacagggtcaaacaatgaagaccccacagctctctcctttgttgctggtccttgtttatttatgactttcttgtacatatatatatatgtatgtcccttagcatctgagcctgctgagtatggatgagctctcaccacctactgtagacgccctttttgccaaacttgtagcaaccattgcagaagaaaaactgcggagagaaacgacgtacgtgttctgtatgtatcgcgcatctgcgcatctgtgctggtattcttgcttgtcagccgccattgtacttactcaaactcaagtaatgcagcagttggtgttagtactgctgatggctgccctcatttatgtaagatttgtacaaacttcccagatgaattactgtctaaacttcccagaaaaaaagtc

SEQ ID NO: 2889 - DNA, 2177 bp, Secale cereale
gcccacgccacgccagagcagagccgcgagcacacaatctagctagctacctagccagccagttacgctgcctagcgctcgacaccgcggcaccactgctcagctcggcagctcccttctccctcgcgcgcggcggggcgggggaagatcgaccggccggcgagcgatgtcgagccacgaggcgtgctgcgggaccatgttctgggtgtacctgctctcctgcgcggggctggtgatgttcgcggggctcatgtcggggctcacgctcggcctcatgtcgctcagcctcgtcgacctggaggtgctggccaaggccggcacgccgcaggaccggcgggacgccgccaggatcctgcccgtcgtcaagaaccagcacctgctcctctgcacgctcctcatcggcaactccctcgccatggaggcgctccccatcttcctcgactccctcgtcccttccttcggcgccatcctcatctccgtcaccctcatcctcgccttcggtgagatcatgccgcaggccatctgcacgcgctacgggctcagcatgggggccaaggcggcgcccatcgtccgggtgctcctcgtcgtcttcttcccggtcgcctaccccatcagcaagttgctcgattggctgctgggaaagggccatgttgcacttatgaggagagctgagctaaagacattagttgatatgcacggtgatgcggctggaaaaggtggggagctgactcatgatgaaactactatcattgcaggagcattagagatgactcaaaagactgcaaaagatgccatgactcccatatctgaaaccttctcccttgacataaatgccaagctcgatgtgcatacagtgggtatgataatgaccaaagggcacagccgtattccaatatactctggaagaccaagcaatattatcggtcttatattggtaaaaaacttgcttacttgccgacctgaggatgaggtgcccactagacatgttactatcagaaaaattccaagggtggctgatgatcttcctctctatgacattctaaatgagtttcagaaaggtcacagccacatggctgtggttgttaaacgcactaaagaagaaggcgcaactgccgaaaagaataacagttttacaccagattacaaaatggccaacggacatgctcatgctgatggtctcggtctgtcaccctcgcatgtcaacattcccggaggtcgtcggaataacaatgacaagtacagtaagaaaatcgaaagaaaacgggacaacattcttgattttaacaccgatccacttcctcattattcaatggatgaggaagcggtgggaataattacgatggaagatgtcatggagacactgctgcaggaagatatcttggatgaaacagatgagtatgttgatgtgcataacaagatcaaaataaacatgttaccgcctggcaaaccattgtcgcctcttatatctcctagtgctggacctttgtctcaagggctaagaaagacccctatggcttctccgatgtcaccataccataatggcggcaccatcttgcattcccctgttgcaaaccatgctcgatcccctgggactttaccgacgatgctttctcctggaaggtcacccgcgtctcaaactcccggccgcagttcgccgacttcaagttgggtctcgaggaattcgtaccgaaatccgtagaaatggtggtgagagctaaagccaaagagctcagggggcaacaatcccagttgagatcactcccaagatcaaattaaggcactgaagagtacagggtcaaacaatgaagaccccacagctctctcctttgttgctggtccttgtttatttatgactttcttgtacatatatatatgtatgtcccttagcatctgaactgagtatggatgagctctcaccacctactgtagacgccctttttgccaaacttgtagcaaccattgcagaagaaaactgcggagagaaacgacgtaaacgaaacgcgttctgtatgtatcgcgcatctgcgcatctgtgctggtattcttggttgtcagccgccattgtacttactcaaactcaagtaaagcagctgttgttggtgctagcactgctgatggctgcccacatttatgtaagatctgtacaaacttcccagatgaattactgtctaaacttc

SEQ ID NO: 2890 - DNA, 2196 bp, Hordeum vulgare
gcacgccgcagccgatcgcgccccacaccacactccaccccgcagcacagccgcgagcacacagccacccagccagccagttacgcacgccagcgctcgacaccgcggctcggcggctccgtccgtccgtccccttctccctcgcggcaaggaagggggggagctcgcacgggccggccggcgagcgatgacgagccacgaggcgtgctgcgggaccatgttctgggtgtacctgctgtcctgcgcggggctggtgatgttcgcggggctcatgtcggggctcaccctcggcctcatgtcgctcagcctcgtggacctggaggtgctggccaaggccggcaccccgcaggaccggcgcaacgccgccaggatcctgcccgtcgtcaagaaccagcacctgctcctctgcacgctcctcatcggcaactccctcgccatggaggcgctccccatcttcctcgactccctcgtgccctccttcggcgccatcctcatctccgtcaccctcatcctcgccttcggtgagatcatgccgcaggccatctgcacgcgctacgggctcagcatgggggccaaggcggcgcccatcgtccgggtgctcctcgtcgtcttcttccccgtcgcctaccccatcagcaagctgttggattggctactgggaaagggccatgttgcacttatgaggagagctgagctgaagacattagttgatatgcacggcgatgcggctggaaaaggtggagagctgactcatgatgaaactactatcattgcaggagctttggagatgactcagaagactgcaaaagatgccatgactcccatatctgaaaccttctcacttgacataaatgccaagttggatgtgcatacagtgggtatgataatgaccaaagggcacagccgtattccaatatactctggaagacctagcaatattatcggtcttatattggtaaaaaacttgcttacttgccgacctgaggatgaggtgcccactagacatgttactatcagaaaaattccaagggtggctgatgatcttcctctctatgacattctaaatgagtttcagaaaggtcacagccacatggctgtggttgtcaaacgcactaaagaagcaggagcatctgctgaaaagaatagcagttctacaccagattacaaaatgaccaacggatatgctcatgctgatggtctgggtttgtcaccctcgcatgtcaacattcccggaagtcgtcgaaataacaatgctaagtacagtaagaaaattgaaaggaaacgggacaacattcttgattttaacaccgatccacttcctcattattcgatggatgaggaagctgtgggaataattacgatggaggatgtcatggaagaattgctgcaggaagatatcttggatgaaacagacgagtatgttgatgtgcataacaagatcaaaataaacatgttaccgccaggcaaatcagtgtcgcctcttgtatctcctggtggtgaacctccatctcaaggaataagaaagacccctatggcttctccgctttcgccataccataatggcggctccatcttacgttcccctgttacaaaccaaactcgatcacctgggactttaccgacagccttttctcctgggaggtcacccgcgtctcaaactcccgtgcgcagttcgccgacttcaagttgggtatcgaggaattcctaccgaaatccgtagaaatagtggtgagggctaaagccgccaaagagctcagggggcaacacttgcagctgagatcactcccaagatcaaagtaaggcactgaagagtatagggtcaaacaaatgaagaccccacagctctctcctttgttgttgatccttgtttatctatgactttcttgtacatgtatatatatatgtgtgtcccttagcatctgagcctgagcgtggatgagctctcaccacctacctactgtagacgccctttttgccaaacttgtagccaccattgcagaagaagaaaactgcagagataaggtagtaaacgaaatgcattatgtatgtatcgcgcgtcggcgcatctgtggaagtattcttgtttgtcagccgccattgtactcaaaaactgaagtaaagcagctgctggctgcccccatttatgtaagaattgttcaagcttggtgtttctgatgcattttttcaaggtcgctg

SEQ ID NO: 2891 - DNA, 2077 bp, Secale cereale
gagcagagccgcgagcacacaatctagctagcacgctagccagccagttacgctagccagagctcgacaccgcggcaccaccgctcggctcggcagctcggccgtcgtccccttctccctcgcgggaagatcgaccggccggcgagcgatgtcgagccacgaggcgtgctgcgggaccatgttctgggtgtacctgctctcctgcgcgggctggtgatgttcgcgggctcatgtcgggctcacgctcggcctcatgtcgctcagcctcgtcgacctggaggtgctggccaaggccggcacgccgcaggaccggcgcgacgccgccaggatcctgcccgtcgtcaagaaccagcacctgctcctctgcacgctcctcatcggcaacctccctcgccatggaggcgctccccatcttcctcgactccctcgtcccctccttcggcgccatcctcatcctccgtcaccctcactcctcgccttcggtgagatcatgccgcaggccatctgcacgcgcgtacgggctcagcagtgggggccaaggcggcgcccatcgtccggtgctcctcgtcgtcttcttcccggtcgcactacccatcagcaagctgttggattggctacgtgggaaaggccatgttgcacttatgaggagagctgagctaaagacattagttgatatgcacggcgatgcggctggaaaaggtggggagctgactcatgatgaaactactatcattgcaggagcattagagatgactcaaaaaactgcaaaagatgccatgactcccatatctgaaactttctcacttgacataaatgccaagctggatgtgcatacagtgggtatgataatgaccaaagggcacagccgtattcctatatactcgggaagaccaagcaatatcatcggtcttatattaggtaaaaaacttgcttacttgccgacctgaggatgaggtgcccactagacatgttactatcagaaaaattccaagggtggctgatgatcttcctctctatgacattctaaatgagtttcagaaaggtcacagccacatggctgtggttgttaaacgcactaaagaagaaggagcatctgctgaaaagaataataacagttttacaccagattacaaaatgaccaacggacatgctcaagctgatggtctcggtctgtcaccctcgcatgtcaacattccaggaagccgtcgaaataacaatgacaagtacagtaagaaaattgaaagaaaacgggacaacattcttgattttaacaccgatccacttcctcattattcaatggatgaggaagcagtgggaataattacgatggaagatgtcatggagacactgctgcaggaagatatcttggatgaaacagatgagtatgttgatgtgcataacaagatcaaaataaacatgttaccgccaggcaaatcattgtcgcctcttatatctcctagtggtggacctctgtctcaaggtctaagaaagacccctatggcttctccgctgtcgccataccataatggcggctccatcttgcgttcccctgttgcaaaccatgatcaatcccctgggactttaccgacgatgctttctcctggaaggtcaccggcgtctcaaactcccgggcgcagttcgccgacttcaagttgggtgtcgaggaattcgtaccgaaatccgtagaaatggtggtgagagctaaagccagagagctcagggggcaacaatcccagttgagatcactcccaagatcaaattaaggcactgaagagtacagggtcaaacaatgaagaccccacagctctctcctttgttgctggtccttgtttatttatgactttcttgtacatatatatatatatgtcccttagcatctgagcctgctgagtatggatgagctctcaccacctactgtagacgccctttttgccaaacttgtagcaaccattgcagaagaaaactgcggagagaaacgacgtaaacgaaacgtgttatgtatctatcgcgcatctgcgctggtattcttgcttgtcagccgccattgtactcactcaaactcaagtaatgcagctgt

SEQ ID NO: 2892 - DNA, 1918 bp, Triticum aestivum
tcaccctgggcctcatgtcgctcagcctcgtggacctggaggtgctggccaaggccggcaccccgcaggaccggcgcaacgccgccaggatcctgcccgtcgtcaagaaccagcacctcctcctctgcacgctcctcatcggcaactccctcgccatggaggcgctccccatcttcctcgactccctcgtgccctccttcggggccatcctcatctccgtcaccctcatcctcgccttcggtgagatcatgccgcaggccatctgcacgcgctacgggctgagcatgggggccaaggcggcgcccatcgtccgggtgctcctcgtcgtcttcttcccggtcgcctaccccatcagcaagcttttggattggttactgggaaagggtcatgttgcacttatgaggagagctgagctgaaaacattagttgatatgcacggcgatgcggccgggaaaggtggagagctgacccatgatgaaactactatcattgcaggagcattagagatgactcaaaagagtgcaaaagatgccatgactcccatatctgaaaccttctcacttgacataaatgccaagctggatgtgcatacggtgggtatgataatgaccaaagggcacagccgtattcctatatactctggaagaccaagcaatatcatcggtcttatattggtaaaaaacttgcttacttgccgacctgaggatgaggtgcccactagacatgttactatcagaaaaattccaagggtggctgatgatcttcctctctatgacattctaaatgagtttcagaaaggtcacagccacatggctgtggttgttaaacgcactaaagaagacggagcatctgccgaaaagaataacagttttacaccagattacaaaatgaccaacgggcatgctcatgctgatggtctgggtctgtcaccctcgcatgtcaacatttccggaagtcgtcgaaataacaatgacaagtacagtaagaaaattgaaagaaaacgggacaacattcttgatttcaacaccgatccacttcctcactattcaatggatgaggaagcggtgggaataattacgatggaagatgtcatggagcaactgctgcaggaagatatcttggatgaaacagatgagtatgttgatgtgcataacaagatcaaaataaacatgttaccgccaggcaaatcattgtcgcctcttatatctcctagtggtggacctctgtctcaaggactaagaaagacccctatggcttctccattgtcgccgtaccataatggcggctccatcttacgttcccctgttacaaaccatgctcgatcacctgggactttaccgacgatgttttctcctggaaggtcaccggcatctcaaactcccgtgcgcggttcgccgacttcaagttgggtctcgaggaattcgtaccgaaatccatagaaatggtggtgagagctgatgccaaagagctcagggggcaacaatcccagttgaggtcactcccaagatcaaattgaggcactgaagagtgtagggtcaaagaatgaagaccccacagctctctcctttgttgctggtccttgtttatttatgattttcttgtacatatatatatgtcccttagcatctgaactgagtatggatgagctctcaccacctactgtagacgccctttttgccaaacttgtagcaaccattgcagaagaaaactgcggagagaaacgacgtaaacgaaacgcattctgtatgtatcgcgcatctgtgctagtattcttgtttgtcagccgccattgtactcactcaaactcaagtatagcagctgttggtgctagtactgctgatggctgcccccatttatgtatgaattgtacaagcttatgtttctaatgagtttcattgtgaatatgcattttgctttc

SEQ ID NO: 2893 - DNA, 2225 bp, Brachypodium distachyon
cggcagaaaggcatcgcaggcgcgccgtatcccaaccaaccaacggaacccacaaaccataaaaagcccccagagagagtccgaacccaccaaacgcacgcgcgcgccacagtgaatctagctcctccttactttcatttacgcccccgcgcccgacacctcaacactcctctgctctgccctccttcttctccggagacggcggcaggatccatgtcgagccaccaggagtgctgcgggaccatgttctggatgtacctggccttctgcgtgctgctggtgctgtttgcggggctcatgtcggggctcacgctgggcctcatgtcgctcagcctcgtggacctggaggtgctcgagaaggccgggacgccgcaggacaggctcaacgccgccaggatcctccccgtggtcaggaaccagcacctgctcctctgcacgctcctcatcggcaactcgctcgccatggaggcgctccccatcttcctcgactccctcgtcccctccttcggcgccgtcctcatctccgtcaccctcatccttgccttcggtgagatcatgccgcaagccatctgcacccgctacggcctccgcatgggggccaaggcggcgcccgtagttcgggtgctcctcgtcgtcttcttccccgtcgcctaccccatcagcaagttgctggactggctactcggaaagggccatttcgcacttatgaggagagctgagctaaagacattagttgatatgcacggcgatgcggctggcaaagggggagagctgactcatgatgaaactactatcattacaggagctttggagatgactcaaaagacagcaaaagatgccatgactcccatatccgaaactttctcacttgacataaacgctaagctggaccggcatacggtgggtatgataatgaccaaagggcacagccgtattcctatatactctggaagaccaagcaatattatcggtcttatattggtaaaaaacttgcttacttgccgacctgaggatgaagtgcccactcgacaagttactatcagaaaaattccaagggtggctgatgatcttcctctctatgacattctaaatgagtttcagaaaggtcatagccacatggctgtggttgttaaacgctctaaagaagcaggagcatctgctgaaaagattaatggggctgcagcagattacaagattaaccacaaacatgttcatgctgacggtttgtcaccctcacatgtcgacattcctggaagtcgtagaaataaccttgaaaagggagatttgcgctcacatagtaagaaatttgaaagaaagcgggataatattcttgattttaacaccgacccacttccaagctattcaatggacgaggaagcagtgggaataattacgatggaagatgtcatggaacaactgctgcaggaagatatcttcgatgaaacagacgagtatgttgatgtacataacaagatcaaaataaacatgctacctccaggaaaatcattgtcacctcttatatctcctagtggtggaccgctatctcaagggctgcggaagacccctatggcttctccattatcaccataccgcaatggtggttccatcttgcgttcccctgtttcaaaccatgctcagtctcctgggatttattcgacgacaatttctcctggaagatcacccatgtctcaaacaactgtgagcagttcgccgacttcaagttgggtctcgaggaattcctacagaagaacatagagatggtggtgagaactgagcctatgaactcaaggggcaacaattcccacctgtggctcatccccagatcaaattaaggcattgttgaccgtaggattaaaagatgaagatcctacggctcccctctatggtcggtccttatttgttggcttgtaaatatctctctctctcttagcatctgaacatacggattagctcttgccacctatggccggtgtggctttttttgccaacctgtagcgaccattgcagaagaaactgcagagaaaatgtaaacgagatgcatttatatgtactgtgcatttgcactattcttgttttgccagccccaattactcaagtaaaccagctgttggtgtatcgctgatgactgtcctataatgtaagcattgtagtaactccttcgtgttgtggcttgagagaagggtcatgactcatgactatatacagaggcttatgtttctagtgca

SEQ ID NO: 2894 - DNA, 3802 bp, Pennisetum glaucum
tgaagcagtcccaaggtggcctgtttggctggcttcttggggggaaatcaagccaacttcctccccttgatgtcccgctcccaggcattactattcccccacctctaccggactttgtagagccatctaagacaaaaatcactactcttccaaatggtatcaagattgcctcggagacatcagcgagcccggcagtatcagtgggtctgtacattgactgtggctctatttatgaaacacctgcttcatctggagtgtcacatctattggagagaatagccttcaagagcacaatgaatcggagtcacttgcggctggttcgtgaggtagaagccattggaggaaatgtctccgcttcggcttcccgtgaacaaatgagctatacctatgatgcattaaagagctatacaccagaaatggttgaagttctcatcgacagtgtgaggaatccagcatttttggattgggaggtcaaagagcagctccagaagataaaatctgaaatagctgaagtgtctgctaatcctcaaggtctactactggaggcacttcattcagctggatattctggggcgctagcaaaacctttgatggcttcagaatccgctgtgaaccgattggatgttagcgtcttggaggaatttgtttctgaacattacactgcacccaggatggttcttgcagcatcaggagttgagcatgatactttggtgtcagttgtagaaccacttctatctgaccttcccagtgcgaaacgtcctgaagagccaaaatcagtgtacgtgggaggggactatcgttgccaagcagattctccaagcacacacattgcacttgcttttgaggtgacaggtggctggaatcaagagaaaactgcaatggttgtgacagtgcttcagatgctcatgggaggaggagggtccttctctgctggtgggcctggaaagggaatgcattctcgattgtatctccatatcttgaccaactacccacagattgaatcattctctgctttcaacagtgtctacaacaattcgggtctttttggaatttatgcagttactagcccggacttctcatcaaaggctgtggatttggcagccggggaactccttgagattgcaactcctggaaaagtttcacaagaacagcttgatcgtgctaaagaggcaaccaaatctgcagttctgatgaacttggaatcaaggtctatagcatctgaagatattggaagacaggttctgacttatggggaaaggaaacccattgaatatttcctgaaaactgttgaggagattactttgaatgacatctcgtcaactgcaaagaaaatgatgtcctcaccgcttacaatggcatcatggggtgatgttattcatgttccaagctatgagtctgtcagccgaaagttccactcaaagtgatcactcttattggacttgcatgacctgttgttccaacaattccaacatttggagttgaagcctgcagcagccctcagctggaataactcgcctatcaaatgtttgatggatagttactcagaataataatcatgtggttcagtgccccccaccctgcattcacatgctcatcatatttctaatgaaaaatctgcaagttacttcgcaatcgtatgtaatagatttgatatagacaactgatctttctggccagaaagactcatcttttgcagaaaaaatcaggttatttttgcttaaatatatgaagtccaacctccccccacctccccaggtgactacaacaagacaaccaaaaaagaataagaaatacacaggaagacttgctgccatacatacatacatattcagaattaggccatactcaggtccacatgctgaagcatatatatatacaggcaaagcaatcaataaataaggaccaataaccatacaagagagcggtgctactatttttcacagcttaatcctacactagcaaagtcacaatccgatcattccatcttgagatgagaccttaatcagaagtaacggtcttcgttccctgtactcttagctctcaatatcctttttatgtttaccgttggaatttcttgaatcctgacttgaatttggtgaactttgcccagcagttgatcttccaggagaaagtatcgtgggcaaaatcccaggtgactggccatgggttgaaactggggaacgtaagacagaactaccatggttgtacggtgacagcggagatgccataggggtcttccgaaacccctgagataggggtccaccgctaggagatatagctggtgacaatgatttgcctggaggtaacatgtttatcctgatcttgttgtgtacatcaacatactcatctgtttcgtcatagatttcctcctgtagcagttcttccatgacatcttccattgtgattattccaactgcttcctcgtccatagaatagcttggaagtggatcagtgttaaaatcaagaatgttttcccgcttcctttctgatttcttattgtatgaccgtccatctccagacttctctatgttatttctacgacttccaccagtgctaacagacgaaggggatgaaccatcagcatgagcatctttgggatttattttataatctgcggtagtgctcttttgcttttcattggatgctcctgcttcctttgttcttttaactaccacagccatgtggctgtgacctttctggaactcatttagaatgtcatatagaggaagatcatcagccacccttggaatttttctgatagtaacatttcgaatgggcacttcatcttcagttcggcaagtaatcaagtttttaaccaatataagcccaatgatattgcttggactccccgagtatataggaacacgactatgccctttagtcattatcatacccattgtatgcaggtccagcttagcatttatgtcaagtgagaatgtttcagatatagaggtcatggcatcttttgcaatcttctgagtgagctccagagctcctgtaatgatagtggtttcatcatgggtcagctctccaccttttccagcctcattgccgtgcatatcgactaacgtcttcagctcagctcttctcattagtgcgaaatggccctttccaagtagcctgtccaacaacttgctgatggggtatgcgacggggaagaagaggatgagaagaacccggaccacgggggcggccttggcccccacgctgaggccgtagcgcgtgcagacggcttgcgggatgatctcgccgaacgcaaggatgagcgtgacggagatgaggatggcgacgaaggacgggacgagcttgtcgaggaatatgggcagcgcctccatggcgagcgagttgccgatgaggagcgtgcagaggagcaggtgctggttcttgacgaccgggaggatcctctcggcgttgagcttgtccttgggcgttccggccttggcgagcacctcgaggtcgacgaggctgagcgacatgaggccgagggtgaggcccgacatgaggccggcgaacatgacgagcgcgaagcaggccatgaggtagacccagaacatggagccgcagcaggcctcatggtcggccatctgcagctgcggcggagcgagctggggcggtgcgggatggtggggggccgggaggacggacgactaggtagcggcgtcgcgtgggagtgggagtgggagtggaacgcaacgaaccgtgccgccctgctgctgctgctgctctgttcgcagtcccagcaacagctcccgctcccgctcccgctcccccaccatcccgcaccgccccagctcgctccgcc

SEQ ID NO: 2895 - DNA, 2102 bp, Setaria italica
gcgagcagcagggacacggttcgttgcgttccacttccgcacgacgccgctagctagtcctcccggctcccgcacccccagctcccgccgcagctaccaccactcccccagctgcacaagtgcagatgcccagccatgaggcctgctgcggcaccatgttctgggtctacctcacggcctgcgtcgggctcgtcttgttcgccggcctcatgtccggcctcaccctggggctcatgtcgctcagcctcgtcgacctcgaggtgctcgccaaggccggaaagccaaaggacaagctcaacgccgagaggatcctcccggtcgtgaagaaccagcacctgctcctctgcacgctcctcatcggcaactcgctcgccatggaggcgctgcccatattcctcgacacgctcgtcccgtcctacgtcgccatcctcatctccgtcacgctcatccttgcgttcggcgagatcatgccgcaagccatctgcacgcgctacgggctcagcgtgggggccaaggccgcgccggtggtccggattcttctcatcctcttcttccccgtcgcatacccgatcagcaagttgttggactggctacttggaaagggccatttcgcactaatgagaagagctgagctgaagacgttagttgatatgcacggcaatgaggctggaaaaggtggagagctgactcatgatgaaaccactatcattacaggagctctggagctcactcaaaagattgcaaaagacgccatgacttctatatctgaaacattttcacttgacataaatgctaagctggacctgcatacaatgggtatgataatgactagagggcatagtcgtgttcctatatactcggggagtccaagcaatatcattgggcttatattggttaaaaacttgattacttgccgaactgaagatgaagtgcccatacgaaatgttactatcagaaaaattccaagggtgaatgatgatcttcctctctatgacattctaaatgagttccagaaaggtcacagccacatggctgtggtagttaaaagaacaaaggaagcaggagcatccaatggaaagcaaaagagcactactgcagattataaaataaaccccaaagatgctcattctgatggttcatccccttcgtatgttagcactgctggaagtcgtagatataacatagagaagtatggagatgggcgttcatacaataagaaatcagaaaggaagcgggaaaacattcttgattttaacaccgatccacttccaagctattctatggatgaggaagcagttggaataatcacaatggaagatgtcatggaagaattgctacaggaagaaatctacgatgaaacagatgagtatgttgatgtacataacaagatcaggataaacatgttacctccaggcaaatcattgtcaccagctatatctcctggtggtggacccctatctcatgggcttcggaagacccctatggcatctccgctatcaccgtacaaccatggtagttctttcttacgttccccagtttcaaaccatggtcagtcacctgggattttacccacaatactttctcctggaagatcacctgcttcacaaacacctgggcaaagctcaccaaattcgagtcaggattcaagaaattccaacggtaaacataaaaaggatattgagagctaagagcccagaaacgaagaccgttacttctgattaaggtctcatctcaagatggaacgatcggactatgactttgctagtgtaggattaagctgcgaatgttgtagcacagctttcttatatggttattggtccttatttatttattgcttgcctgtatatatatgtgcttcagcatatggacctgagtatggtctaattctgaacatgtattgcagaagtcttcctatggatttcttcttcttttttggttgtcttgtagttacctgggaaaaaaaaacctaagtcgttggacttcatatatttaagcaaaaatcacctgattttgccacttccgatccctgcccccattatgtaagcattctcctgaatccactgtgctatggagagaatagtgatgagtttggatgcagtcag

SEQ ID NO: 2896 - DNA, 2129 bp, Panicum virgatum
ccatgccatgctttgccagccaccataaagcagcaggagaaggagccggctgctccagcttggtaggccgcgcagaccagagagaccacgcagagctcagctgctgccggggcagcagcacagcagggacggacacggttccacagtcccacacacaagttacaactacaactactctaccgctccagcttccctccgcagagcagccaccaccaccacagagcaacaagcaccactgcccccggcggccctcccgtcccctgccgagaccattagaccaagcaagctccgcctccgggtgggagggatcgccgatgcccagccatgaggcctgctgcggcaccatgttctgggtcttcctcaccgcctgcgtggggctcgtcatgttcgccggcctcatgtcgggcctcaccctggggctcatgtcgctcagcctcgtcgacctcgaggtgctcgccaaggccggcacaccaaaggacaggctcaacgccgccaggatcctccccgtcgtcaagaaccagcacctgctcctctgcacgctcctcatcggcaactcgctcgccatggaggcgctgcccatattcctcgacacgctcgtgccctccttcgtcgccgtcctcatctccgtcacgctcatccttgcgtttggcgagatcatgccgcaagccatctgcacgcgctacggcctcagcgtgggggccaaggccgcgccggtggtccggattcttctcatcctcttcttccccgtcgcctacccgatcagtaagttgttggactggctgttgggaaagggccatttcgcactaatgagaagagctgagctaaagacgctagttgatatgcacggcaatgaggctgggaaaggtggagagctgactcatgatgaaaccactatcattacaggagctctggagctaactcagaagattgcaaaagatgccatgactcctatatccgaaacattctcacttgacataaatgctaagctggacctgtatacgatgggtatgataatgactagagggcatagtcgtgttcctatatactcaggaagtccaagcaatatcattgggcttatattggtaaaaaatttgattacttgccgagctgaggatgaagtgcccattcgaaatgttactatcagaaaaattccaagggtggctgatgatcttcctctctatgacattctaaatgagttccagaaaggtcacagccacatggctgtggtagttaaacgaacaaaggaagcaggaccatccactgaaaagcaaaagagcactactgcagattataaaataaaccccaaagatgctcatgctgatggttcatcctcttcgtatgttagcactgctggaagtcgtagaaataacatagagaagtatggagatggacgctcatataataagaaatcagaaaggaagcgggaaaacattcttgattttaacactgatccacttccaagctattcaatggatgaggaagcagtcggaataatcacaatggaagatgtcatggaagaattgctacaggaagaaatctacgatgaaacagatgagtatgttgatgtacataacaagataaagataaacatgttacccccaggcaaatcattgtcacctgctatatctcctggtggtggaaccctatctcaggggctcaggaagactcctatggcatctccactctcaccatacaaccatggtagctctgttttccgttccccagttcggaaccatggtcagtcacctgggactttacccacaatactttctcccaggcaaagttcgccaaattcaagtcaggattcaagaaattccaatggtaaacataaaaaggctggtgagagctaacagcccagaacgaaggccttcatctccgattaaggtcttgtctcaagatgggatgatcgaattatgactttactagtgtagaactaagctgtgagtatagaagcacagcgctcttttatggatattggtccttatttattgattgcttgcctgtacatatgtgcttcagcatatgggcctcggtatggacttctcaatatgtatcgtagcagtattcctaaggacttgttggttcctctcttttttttggtcgccttgtagttacctgggaaacccccc

SEQ ID NO: 2897 - DNA, 2339 bp, Panicum virgatum
caccacccacccaacaggccagcaacggtgtccgagctggactcgttgccgttactgcccgaccggttcgccgcaacggaatcggaaagccaccgcggcgccgagccaaaacggccggccggcgcgccccaatgacccccagccggccatgccatgccttgccttgccagccaccataaagcaggagccggcgggcgcggctccagctagctagtccgcgcagaccagaccacgcagagctcacagctgctaccccgggcaggcagcagggagtcagggacggacacggttccacagtcccacgcacaactacaactactctacccctccagcttccctccgcggccaccaccacagcacagagcaccactgccccgacggccgaccaccctcccgtcccccgccgagactaagcaggctccgcctccgggtgggatcgccgatgcccagccatgagccctgctgcggcaccatgttctgggtcttcctcaccgcctgcgtggggctcgtcatgttcgccggcctcatgtcgggcctcaccctggggctcatgtcgctcagcctcgtcgacctcgaggtgcttgccaaggccggcacaccaaaggacaagctcaacgccgccaggatcctccccgtcgtgaagaaccagcacctgctcctctgcacgctcctcatcggcaactcgctcgccatggaggcgctgcccatattcctcgacacgctcgtgccctccttcgtcgccgtcctcatctccgtcacgctcatccttgcgtttggcgagatcatgccgcaagccatctgcacgcgctacggcctcagcgtgggggccaaggcggcgccggtggtccggattcttctcatcctcttcttccccgtcgcctacccgatcagtaagttgttggaccggctgctgggaaagggccattttgcactaatgagaagagctgagctaaagacgctagttgatatgcacggcaatgaggctggaaaaggaggagagctgactcatgatgaaacaactatcattacaggagctctggagctaactcagaagattgcaaaagatgccatgactcctatatccgaaacattctcacttgacataaatgctaagctggacctgcatacgatgggtacgataatgaccagagggcatagtcgtgttcctatatactcaggaagtccaagcaatatcattgggcttatattggtaaaaaatttgattacttgccgaactgaggatgaagtgcccattcgaaatgttactattagaaaaattccaagggtggctgatgatcttcctctctatgacattctaaatgagttccagaaaggtcacagccacatggctgtggtagttaaacaaacaaaggaagcaggagcatccactgaaaagcaaaagagcactgctgcagattataaaataaaccccaaagatgctcatgctgatggttcatccccttcgtatgttagcactgctggaattcgtagaaataacatagagaagtatggagatgggcgctcatataataagaaatcagaaaggaagcgggaaaacattcttgattttaacaccgatccacttccaagctattcaatggatgaggaagcaattggaataatcacgatggaagatgtcatggaagagttgctacaggaagaaatcttcgatgaaacagatgagtatgttgatgtacataacaagataaggataaacatgttacccccagtcaaatcattgtcacctgctatatctcctggtggtggacccctatctcaggggctcaggaagactcctatggcatctccgcgctcaccatacaaccatggcagctctgtcttccgttccccagtttggaaccatggtcagtcacctgggactttacccacaatactttctccagggcaaagttcaccaaattcaagtcaggattcaagaaactccaatggtaaacaaaaaaaggatggtgagagctaacatcccagaacgaaggcctttatttcagattaaggtcttgtctcaagatggcatgatatcgattatgactttactagagtagaactaagctgcgagtatagaagcacagcactcttttatggatattggtcctttatttattgatgatgattgcttgcctgtacatatatgcttcagcatatgggcctcggtatggagtaattctcaatatgtattgtagcagtattcctaaggacttgttggttcctccctttttttcttgtcgcccaaaagcgtgggacttcatatatttaaccaaacatcacctgattttgccacttctgatccctgcccccgttatgcaagcattctactgaatcca

SEQ ID NO: 2898 - protein, 293 aa, Triticum aestivum
MESVEGNGTGRGNLQLVVSELCRVQELVRQLELHLHAPDASIDLCRALTAEIFALTDRSIGFVAAAHFPDAPTTPSSTSSSLSGVSDQPFRTNTKKRKATARWTSQVRVSAAGGAEGPGDDGHSWRKYGQKDILGAKHPRAYYRCTHRNSQGCPATKQVQRADQDPALFDVVYHGQHTCRPTGGRRPPTNQHNPHAESLLQSLRAGLTVDADHGALNNTSVSPPSMASPVASGSNGGLAMSPYPVPAGAYTEWPLDGDLQEVVSALTAVSAPSMDCLFEFDPTFGVGVPNFFM

SEQ ID NO: 2899 - protein, 311 aa, Secale cereale
MESVEGNGTGRGNLQLVVSELCRVQELVRQLELHLHAPDTSIDLCRALTAEIFALTDRSIGFVAAHFPDAPTTPSSTSSSLSGVSDQPFRTNTKKRKATARWTSQVRVSAAGGAEGPGDDGHSWRKYGQKDILGAKHPRAYYRCTHRNSQGCPATKQVQRADEDPAIFDVVYHGQHTCRATGGGRRPPTNQHNNPHAESLPAEPQSRPDRGRGPRRPERQCLAAVDGLARGVWLQRWSDHVAVPGAGRRVRGVAFGRRPPGGGVGAHSRVSPEHGLPFRVRPGLRRWCAQLLHVRTTNRAWKCLRISDDDE

SEQ ID NO: 2900 - protein, 608 aa, Secale cereale
MCSGPRKPSTPPPVAAAPKDSVDIASLLLELAAADNVVEFRRVVEEEKACLDAAGSWYGPSAVGLGRLAAESRTPAMVAALYGSTAVLAHALSVAPGEACRASDTDGATALHMAAAGGAANAVAATHLLLAAGASTEALSVSGLRAGDLLPRAAGVSEKPLRLLLKSPAVSPSSSPKKSASPPAMVAAQEPRKEYPPDLTLPDLKSGLFSTDEFRMYSFKVKPCSRAYSHDWTECPFVHPGENARRRDPRRYSYSCVPCPEFRKGGSCRKGDGCEYAHGVFECWLHPAQYRTRLCKDEVGCARRICFFAHRRDELRSVNPSAVSVGMMQPVSPRSSPPNGMDMGMLNPAGWPSSPVSRLKTARELDFDLEMLALDQYQQKLFDKVSNNAHSPRASWGAPNGGLGSPHAAGSPARNMPDYTDLLGSMDPAMLSQLHALSLKQAGDMSPYSSMPDTQLHMPTSPMVGANNSFGLDHSMAKAIMTSRASAFAKRSQSFIDRGARAPAARSLMSPATTIGEPSMLADWGSPSGGGNLDWGSPGGKLDWGVQGDELHKFRKSASFGFRGQTAMPAAAAATPAEPDVSWVNSLVKDGHTGDHFPQWLEQEQMVA

SEQ ID NO: 2901 - protein, 602 aa, Avena sativa
MCSGPRKPSTPPPPVQDSTAMASLLLELAAEDDVAEFRRAVEEDKACLDVEASWYGPSAVGQGRLATESRTPAMVAALYGSASVLAYALSVSPREATRASGTDGATALHLAAAGGAANAVAATHLLLAAGASTEALSASGLRAGDLLPRAATAAEKPLRLLLKSPASSPSSSPKKSATMAAAAQEPRKEYPPDLTLPDLKSGLFSTDDFRMYSFKVKPCSRAYSHDWTECPFVHPGENARRRDPRRYSYSCVPCPEFRKGGSCRKGDGCEYAHGVFECWLHPAQYRTRLCKDEVGCARRICFFAHRRDELRSVNPSAVSVGMMQPVSPRSSPPNGMDGMGMLNPGAWPSSPASRLKTARELDFDLEMLALDQYQQKLFDKVSSSAHSPRASWGAPNGGLGSPRAAASPGRNMPDYTDLLGSMDTAMLSQLHALSLKQAGDMSPYSSLPDSQLHMPTSPMMGANNSFGLDHSMAKAIMTSRASAFAKRSQSFIDRGARAPAARSLMSPATIGEPAMLTDWGSPSGNLDWGSPSGKLDWGVQGDELHKFRKSASFGFRGQSAMPATSPATQAEPDVSWVNSLVKDGHAGGDHFPQWLEQEQMVA

SEQ ID NO: 2902 - protein, 599 aa, Brachypodium distachyon
MCSGTRKPTAPPPPRDSAELLMELAAADDVVGFRQAVEEDKACIDGAGLWYGPSAAVGRRLGMESRTPAMVAALYGSTGVLAYALSAAPREACRASPTDGATALHMAAAGGAAGAVAATHLLLAAGASTEALSASGLRAGDLLPRAAGPADKPLRVLLKSPAVSPSSSPKKSASPPAAMAMAQEPRKEYPPDLTLPDLKSGLFSTDEFRMYSFKVKPCSRAYSHDWTECPFVHPGENARRRDPRRYSYSCVPCPEFRKGGSCRKGDGCEYAHGVFECWLHPAQYRTRLCKDEVGCARRICFFAHKRDELRAVNPSAVSVGMQPSSPRSSPPNGMDMGMLNPAWPSSPASSRLKTARELDFDLEMLALDQYQQKLFDKVSNAASPRANWGAANGGLGSPHAVAQAPPRNMPDYSDLLGSMDTAMLSQLHALSLKQAGDMSPYSSLPDTQLHMPTSPMVGANTSFGLDHSMAKAIMSSRASAFAKRSQSFIDRGARAPAARSLMSPATMGEPSMLTDWGSPSGNNMDWGSPSGKLDWGVQGDELHKFRKSASFGFRAQSAMPVASQATQAEPDVSWVNSLVKDGHSGDHFAQWLEQEQMVA

SEQ ID NO: 2903 - protein, 585 aa, Secale cereale
MCSGPRKPSTPPPVAAAPKDSVDIASLLLELAAADNVVEFRRVVEEEKASLDAAGSWYGPSAVGLGRLAAESRTPAMVAALYGSTAVLAHALSVAPGEACRASDTDGATALHMAAAGGAANAVAATHLLLAAGASTEALSLSGLRAGDLLPRAAGVSEKPLRLLLKSPAVSPSSSPKKSASPPAMVAAQEPRKEYPPDLTLPDLKSGLFSTDEFRMYSFKVKPCSRAYSHDWTECPFVHPGENARRRDPRRYSYSCVPCPEFRKGGSCRKGDGCEYAHGVFECWLHPAQYRTRLCKDEVGCARRICFFAHRRDELRSVNPSAVSVGMMQPVSPRSSPPNGMDMGMLNPAGWPSSPVSRLKTARELDFDLEMLALDQYQQKLFDKVSNNAHSPRASWGAPNGGLGSPHAAGSPARNMPDYTDLLGSMDPAMLSQLHALSLKQAGDMSPYSSMPDTQLHMPTSPMVGANNSFGLDHSMAKAIMTSRASAFAKRSQSFIDRGARAPARAPSCRRPPRSATPSMLTDWGSPSGGGNLDVGSPGGKLDVGRARETSCTSSASRLRSVPRQTAIAGGRRTPTPARTRRLSG

SEQ ID NO: 2904 - protein, 223 aa, Pseudoroegneria spicata
MASGLQVFGQPASTDVARVLTCLFEKNLEFDLVRIDTFKRQHKLPEFIRLRDPSGQVTFKHGDKTLVDPRAICRYLCTQFPNQGNRSLYGTGSLERASIEQWLQAEAQNFNPPSSALVFQLAFAPLLGIPQDHMVIAENERKLQQVLNVYDEILSKNEYLAGDEFTLADLSHLPDSQYIVSSERGMKLFTSRKNVARWFDQISRRKAWEQVVKMQMEHPGAFE

SEQ ID NO: 2905 - protein, 223 aa, Triticum aestivum
MASGLQVFGQPASTDVARVLTCLFEKNLEFDLVRIDTFKRQHKLPEFIRLRDPSGQVTFKHGDKTLVDPRAICRYLCTQFPNQGNRNLYGTGSLERASIEQWLQAEAQSFNPPSSALVFQLAFAPLLEIPQDHMAIAENERKLQQVLNVYDEILSKNEYLAGDEFTLADLSHLPDSQYIVSSERGRKLFTSRRNVARWFDQISRRKAWEQVVKMQMEHPGAFE

SEQ ID NO: 2906 - protein, 223 aa, Secale cereale
MASGLQVFGQPASTDVARVLTCLFEKNLEFDLVRIDTFKKQHKLPEFVRLRDPSGQVTFKHGDNTLVDPRAICRYLCTQFPNQGNRRLYGTGSLERASIEQWLQAEAQNFNPPSSALVFQLAFAPLLGIPQDQMVIAENERKLQQVLNVYDEILSKNEYLAGDEFTLADLSHLPDSQYIVSSERGRKLFTSRRNVARWFDQISRRKAWEQVVKMQMEHPGAFE

SEQ ID NO: 2907 - protein, 227 aa, Brachypodium distachyon
MSAPVTVYGPMISPAVARVAACLLEKDVPFQLQPVDMSKGEHKSPSFLKLQPFGQVPAFKDHLTTVFESRAICRYICDQYADRGNRSLLGREEDGAVGRAAIEQWIESEGQAFNPPSLAIAFQLTFAPLMGRATDIAVVEQNEAKLAKVLDVYEQRLGESQYFAGDEFSLADLVHMPNTDLLVSKTNKAGLITERKNLARWWDEVSVRPSWKKVVEMQSVPRPSKST

SEQ ID NO: 2908 - protein, 222 aa, Oryza sativa
MAAGLQVFGQPASTDVARVLTCLFEKDLEFELVRIDTFKREHKLPEFIKLRDPNGQVTFKHGDKTIVDSRAICRYVCTQFPEGNKTLYGTGSLERASIEQWLQAEAQNFSPPSSALVFHLAFAPHLNIPQDHAVIAENEKKLQQVLNVYDEILSKNEYLAGDEFTLADLSHLPNSHYIVSSERGRKLFTGRKNVARWYDQISKRETWKQVVKMQREHPGAFE

SEQ ID NO: 2909 - protein, 223 aa, Hordeum vulgare
MAAGLQVFGQPASTDVARVLTCLFEKNLEFELVRIDTFKREHKLPEFIKLRDPTGQVTFKHGDKTLVDSRAICRYLCTQFPEDGNRGIYGTGSLERASIEQWLQAESQSFDAPSSELVFHLAFAPQLNMIPDEARIAENERKLQQMLGVYDEILAKNQYLAGDEFTLADLSHLPASHYIAGSQRGRKLFTSKKHVARWYDAISSRPSWKQVVKMQHEHPGTFE

SEQ ID NO: 2910 - protein, 223 aa, Triticum aestivum
MAAGLQVFGQPASTDVARVLTCLFEKNLEFELVRIDTFKREHKLPEFIKLRDPTGQVTFKHGDKTLVDSRAICRYLCTQFPEDGNRGIYGTGSLERASIEQWLQAEAQSFDAPSSELVFHLAFAPQLNMLPDEARIAENERKLQQMLGVYDEILAKNQYLAGDEFTLADLSHLPASHYIAGSQRGRKLFTSKRHVARWYDAISSRPSWQQVVKMQHEHPGTFE

SEQ ID NO: 2911 - protein, 225 aa, Oryza sativa
MAAGLQVFGQPASTDVARVLTCLFEKNLEFELIRIDTFKKEHKLPEFIKLRDPTGQVTFKHGDKTLVDSRAICRYLSTQFPDDGNRTIYGTGSLERASIEQWLQAEAQSFDAPSSELVFHLAFAPQLNIPADEARIAENERKLQQMLNVYDEILAKNKYLAGDEFTLADLSHLPNSHYIVNARSPRGKKLFTSKKHVARWYEEISNRASWKQVVKMQSEHPGAFE

SEQ ID NO: 2912 - protein, 239 aa, Triticum aestivum
MRPRLVLFGDSITEQSFAPGGWGAALAEHFARQADVVLRGLSGYNTRWALKVLDRAMEGAADGGADPAAVTVFFGANDATLPDEVQAHQHVPLGEYKDNLRAICAYFKNKWPSAAIILITPPPIHEPARIRDIYGDNDPSRQPERTNEAAGTYAQACITVAKELGHPVIDIWTQMQQCPDWQTSALSDGLHFTPFGNKILFDEVLKTLESVGFSQHSLRSDLPLFHEIDPKDPLKAFEI

SEQ ID NO: 2913 - protein, 235 aa, Leymus cinereus x Leymus triticoides
LVLFGDSITEQSFSSGGWGAALAEHFARQADVVLRGLSGYNTRWALKVLDRAMEGAADGGADPAAVTVFFGANDANLPDQAQAHQHVPLGEYQDNLRAICAYFKNKWPSAAIILITPPPIHEPARIRDIYGDNDPSRQPERTNEAAGTYAQACITVAKELGHPVIDIWTQMQQFPDWQTSALSDGLHFTPFGNKILFDEVLKTLESVGFSQHSLRSDLPLFHEIDSKDPLKAFEI

SEQ ID NO: 2914 - protein, 235 aa, Pseudoroegneria spicata
LVLFGDSITEQSFAPGGWGAALAEHFARQADVVLRGLSGYNTRWALKVLDRAMEGAADGGADPAAVTVFFGANDASLPDQVQAHQHVPLGEYKDNLRAICAYFKNKWPSAAVILITPPPIHEPARIRDIYGDNDPSRQPERTNEAAGTYAQACIAVAKELGHPVIDIWTQMQQFPDWQTSALSDGLHFTPFGNKILFDEVLKTMESVGFSQHSLRSDLPLFHEIDPKDPLKAFEI

SEQ ID NO: 2915 - protein, 239 aa, Secale cereale
MRPRLVLFGDSITEQSFSPGGWGAALAERFARQADVVLRGLSGYNTRWALKVLDRAMEGAADGGPDPAAVTVFFGANDATLPDQAQAHQHVPLGEYKDNLRAICAYFKNKWPSAAIILITPPPIHEPARIRDIYGDNDPSRQPERTNEAAGTYAQACIVVGKELGHPVIDIWTQMQQFPDWQTSALSDGLHFTPSGNKILFDEVLKTLESVGVSQHSLRSDLPLFHDIDPKDPLKAFEI

SEQ ID NO: 2916 - protein, 239 aa, Brachypodium distachyon
MRPRLVLFGDSITEQSFSPGGWGAALAEHFARQADVVLRGLSGYNTRWALKVLDRAMEGAAAGAADPAAVTVFFGANDANLPDQPQAHQHVPLEEYQANLRAICAHFKNQWPSAAVILITPPPIYEPARILDIYGDNAPSRQPERTNEAAGTYAQACIAVAKELDHPVIDIWTKMQQFPDWQTSALCDGLHFTPFGNKILFDEVLKTLGSIGFSQHSLPSDLPLFHEIDPKDPLKAFEI

SEQ ID NO: 2917 - protein, 239 aa, Avena sativa
MRPRLVLFGDSITEQSFASGGWGAALADHFARQADVVLRGLSGYNTRWALKVLDRAMEGVAAGGADPAAVTLFFGANDASLPDQPQAHQHVPLDEYQDNLRAICASLEKKWPSAAIILITPPPVHEPARILHMYGDNAPSRQPERTNESAGAYAQACIAVAKELDHPVIDIWTQMQKFPDWQTSALCDGLHFTPSGNKILFDELLKTLESIGFSQHSLRSDLPLFHEIDPKDPLKALEI

SEQ ID NO: 2918 - protein, 239 aa, Sorghum bicolor
MRPRLVLFGDSITEQSFASGGWGAALTDRFARQADVVLRGLSGYNTRWALKVLPRAMEGAAGAGADPAAVTVFFGANDATLPDQVQAHQHVPLQEYQSNLRAISAYFKERWPSTAIILITPPPIYEPARIRDVYGEDDPSRQPERSNEAAGAYAQACIAVATELNHPVIDIWTKMQEFPDWQTSALSDGLHFTPAGNKILFDEVVKTLESIGFSQERLPSDLPLFHEIHPKDPMKAFGA

SEQ ID NO: 2919 - protein, 239 aa, Pennisetum glaucum
MRPRLVLFGDSITEQSFESGGWGAALADRFARQADVVLRGLSGYNTRWALKVLPRAMEGAADADADPAAVTVFFGANDASLPDQVQAHQNVPLEEYQANLRAICAYFKERWPSAAIILITPPPIYETARIRDVYGVADPSRQAERTNEAAGSYAQACIAVAKELGYPVIDIWTKMQEFPDWQTSALSDGLHFTPTGNKILFDEVVQTLASIGFSNERLPYDLPLYPEIDPKDPMKAFGA

SEQ ID NO: 2920 - protein, 242 aa, Zea mays
MRPRLVLFGDSITELSFASGGWGAALTDRFARQADVVLRGLSGYNTRWALKVLPRAMEGAAGAGAGADPAAVTVFFGANDASLPDQVQAHQHVPLKEYQSNLRAICAYFKERWPSTAVILITPPPIYEPARIRDMYGDDEPSRQPERSNEAAGAYAQACIDVATELNHPVIDIWTKMQEFPDWQTSALSDGLHFTPVGNKILFEEVVKTLETSIGFSQERLPSDLPLFHEIDPKDPMKAFGA

SEQ ID NO: 2921 - protein, 235 aa, Panicum virgatum
MRPRLVLFGDSITEQSFQSGGWGAALTDLFARQADVVLRGLSGYNTRWALKVLPRAMEGAADPAAVTVFFGANDASLPDQVQAHQNVPLDEYQTNLRAICGYFKERWPSTAIILITPPPIYEPARIRDIYGVDDPSRQAERTNEAAGSYAQACMAVAKELGHPVIDIWTKMQEFPDWQTSALSDGLHFTPTGNKILFDEVVKTLASIGFSKESLPSDLPLYHDIDPKDPMQAFGA

SEQ ID NO: 2922 - protein, 237 aa, Setaria italica
MRPRLVLFGDSITEQSFESGGWGAALTDRFARQADVVLRGLSGYNTRWALKVLPRAMEGAADADPAAVTVFFGANDASLPDQVQAHQNVPLEEYQTNLRAICAYFKERWPSAAIILITPPPIYETARIRDIYGVDDSARQAERTNEAAGSYAQACIAVAKELGHPVIDIWTKMQEFPDWQTSALSDGLHFTPTGNKILFDELVQTLAGIGFSKESLPYDLPLYPEIDPKDPMKAFGA

SEQ ID NO: 2923 - protein, 238 aa, Oryza sativa
MRPRLVLFGDSITELSFADGGWGAALADHFARKADVVLRGFSGYNTRWALRVLARAMEGAAAAADPAAVTVFFGANDASLPERKQVHQHVPLDEYQSNLRSICAYFKEQWPSTKIILITPPPIYEPARIRDMYGEDDPSKLPERTNEAAGTYAQACLTVAKELNHPVIDIWTKMQQFPDWQTSALCDGLHFTPLGNKILFDCVLETLESIGFSQGSLQPDLPLFHDIDPKDPLKAFEI

SEQ ID NO: 2924 - protein, 231 aa, Panicum virgatum
LVLFGDSITEQSFQSGGWGAALTDLFARQADVVLRGLSGYNTRWALKVLPRAMEGAADPAAVTVFFGANDASLPDQVQAHQNVPLDEYQTNLRAICGYFKERWPSTAIILITPPPIYEPARIRDIYGVDDPSRQAERTNEAAGSYAQACMAVAKELGHPVIDIWTKMQEFPDWQTSALSDGLHFTPTGNKILFDEVVKTLASIGFSKESLPSDLPLYHDIDPKDPMQAFGA

SEQ ID NO: 2925 - protein, 276 aa, Secale cereale
MGLLSNRIGKESLKAGDHIYSWRAAWVYAHHGIYVGDDKVIHFTRGRDQEVGTGTVIDYLLVSSGPNRSTTPCLVCSSEEATTAAETNGVTSSCLSCFLAGGALYRFEYDVNPALFLAKVRGGTCTLAATDPDEVVVRRAKYLLSNGFRCYSLFKNNCEDFAIYCKTGLLVAEQGNVGLGQSGQAVSIIGGPLAAVVSTPFRLVTTNIYGVAVMAVGVYCVSRYAGDIGNRRDVLKVEVEDLTAGLASGRIRPANISQLATPGQVQVPAVTTLVAA

SEQ ID NO: 2926 - protein, 276 aa, Secale cereale
MGLLSNRIGKESLKAGDHIYSWRAAWVYAHHGIYVGDDKVIHFTRGRDQEVGTGTVIDYLLVSSGPNRSTTPCLVCSSEEATTAAETNGVTSSCLSCFLAGGALYRFEYDVNPALFLAKVRGGTCTLAATDLDEVVVRRAKYLLTNGFRCYSLFKNNCEDFAIYCKTGLLVAEQGNVGLGQSGQAVSIIGGPLAAVVSTPFRLVTTNIYGVAVMAVGVYCVSRYAGDIGNRRDVLKVEVEDLTAGLASGRIRPANISQLATPGQVQVPAVTTLVAA

SEQ ID NO: 2927 - protein, 276 aa, Triticum aestivum
MGLLSNRIGKESLKAGDHIYSWRAAWVYAHHGIYVGDDKVIHFTRGRDQEVGTGTVIDFLLVSSGPTRSTTPCLVCSSEEATTAAETNGVTSSCLSCFLAGGALYRFEYDVNPALFLAKVRGGTCTLAATDPDEVVVRRAKYLLTNGFRCYSLFKNNCEDFAIYCKTGLLVAEQGNVGLGQSGQAVSIIGGPLAAVVSTPFRLVTTNIYGVAVMAVGVYCVSRYAGDIGNRRDVLKVEVEDLTAGLASGRIRPANISQLATPGQVQVPAVTTLVAA

SEQ ID NO: 2928 - protein, 275 aa, Brachypodium distachyon
MGLLSNRIGKESLKAGDHIYSWRAAWVYAHHGIYVGDDKVIHFTRGRDQEVGTGTVIDFLLVSSGPNRSSTPCLVCSSNEVTTATETGVTSSCLSCFLAGGALYRFEYAVNPALFLAKARGGTCTLAATDANEVVVRRANYLLSNGFRCYSLFKNNCEDFAIYCKTGLLVAEQGSVGLGQSGQAVSIIGGPLAAVVSTPFRLVTTNVYGMAVMAVGVYCVSRYAADIGNRRDVLKVEVEDLTAGLASGRIRAANVSQLVTPGQVQVPAVTTLVAA

SEQ ID NO: 2929 - protein, 276 aa, Avena sativa
MGLLSNRTGKETLKAGDHIYSWRAAWVYAHHGIYVGDDKVIHFTRGRDQEVGTGTVIDFLLVSSGPTRSTTPCLVCSSNDATAATEANGVTSSCLSCFLAGGALYRFEYAVNPALFLAKARGGTCTLAPTDPDEVVVRRANYLLSNGFRCYSLFKNNCEDFAIYCKTGLLVAEQGSVGLGQSGQAVSIIGGPLAAVVSTPFRLVTTNIYGMAVMAVGVYCVSRYAGDIGNRRDVLKVEVEDLTAGLASGRIRPANISQLATPGQVQAPVVTTPVAA

SEQ ID NO: 2930 - protein, 392 aa, Oryza sativa
MESSASSSAAVAAEGAPATGEQLAVFWHEGMVAHDAGRGVFDSGRDPGFLDVLDQHPENADRVRNMVSILRRGPIARFISWHSGRPAHAAELLSFHSAEYIEELVQANAVGAKKLCEGTFLNPGSWGAALLAAGTTLSAMKHILDGHAKIAYALVRPPGHHAQPDRADGYCFLNNAGLAVKLALDSGRRKVAVVDIDVHYGNGTAEGFYHTDSVLTISLHMKHGSWGPSHPQSGSVDEIGEGRGLGYNLNIPLPNGSGDAGYEYAMNELVVPAIEKFRPELLVFVVGQDSSTFDPNGRQCLTMDGYRKIGQIMRGMADQHSNGQILIVQEGGYHISYSAYCLHATLEGVLNLQAPLLDDPIAYYPEDEKYTMKVVDIMKKCWKESIPFLKDI

SEQ ID NO: 2931 - protein, 272 aa, Setaria italica
MGLLSNRIGKESLKAGDHIYSWRAAWVYAHHGIYVGDDKVIHFTRGRDQEVGTGTVIDIILVSSAPKRSDTPCPVCTNEGNDSSTETNGVVSSCLNCFLGGGALYRFEYAVNPALFLAKARGGTCTLAPSDPDEAVIRRAKYLLSNGFRCYNLFKSNCEDFAIYCKTGLLVAERGVVGQSGQAISIIGGPLAAVISTPFRLVTTNIYGMAVMAVGVYCASRYAADIGNRRDVVKVEVEDLTAGLASGRIRAVENIAQLVVPAESPAAATIAA

SEQ ID NO: 2932 - protein, 272 aa, Saccharum officinarum
MGLLSNRIGKESLKAGDHIYSWRSAWVYAHHGIYVGDDKVIHFTRSGQEVGTGTVVDILLVSSAPKRSNTPCPVCTNEISDTSTETNGVVSSCLSCFLAGGALYRFEYAVNPALFLAKARGGTCTLAHSDPDDTVIRRAKYLLNNGFRCYNLFKSNCEDFAIYCKTGLLVAERGVVGQSGQAISIIGGPLAAVVSTPFRLVTTNIYGMAVMAVGVYCASRYAADIGNRRDVVKVEVEDLTAGLASGRIRAVENIAQLVAPAAESPATATLAA

SEQ ID NO: 2933 - protein, 275 aa, Sorghum bicolor
MGLLSNRIGKESLKAGDHIYSWRAAWVYAHHGIYMGDDKVIHFTRGSGQEVGTGTVVDILLVSSAPKRSNTPCPVCTNETSDTSTETNGVVSSCLSCFLAGGALYRFEYAVNPALFLAKARGGTCTLACSDPDDTVIRRAKYLLNNGFRCYNLFKSNCEDFAIYCKTGLLVAERGVVGQSGQAISIIGGPLAAVVSTPFRLVTTNIYGMAVMAVGVYCASRYAADIGNRRDVVKVEVEDLTAGLASGRIRAVENIAQLMAPAAESPATATATLAA

SEQ ID NO: 2934 - protein, 265 aa, Panicum virgatum
MGLLSNRIGKESLKAGDHIYSWRSAWVYAHHGIYVGDDKVIHFTRGRDQEVGTGTVIDILLVSSAPKRSDTPCPVCTNEDNDTSMETNGVVSSCLNCFLAGGALYRFDYAVNPALFLAKARGGTCTLATSDPDEAVVRRAKYLLSNGFRCYNLFKSNCEDFAIYCKTGLLVAERGVVGQSGQAISIIGGPLAAVISTPFRLVTTNIYGMAVMAVGVYCASRYAADIGNRRDVVKVEVEDLTAGLASGRIRAVENQLVVPPESPAA

SEQ ID NO: 2935 - protein, 169 aa, Triticum aestivum
MSHFAAMKSPVPVAAAAATDAKSPLFCPKPRRPVAPLRCHQSSHSDAGAGMDLLDLLLSKGDESNLSAASPQPPLFCGSPPRRASNPVVHDSRFGMDCPSSPLPWWPVMSPVTPAPVVVRPTPRPAGPPMSPRSSAGCARVFQPAVRVEGFDCLDGGRSGRGHGIAAMV

SEQ ID NO: 2936 - protein, 169 aa, Secale cereale
MSHFAAMKSPVPVAAAAATDAKSPLFCPKPRRPVAPLRCHQSSNSDVGAGMDLLDLLLSKGDESNLSAASPQPPLFCGSPPRRASNPVVHDSRFGVDCPSSPLPWWPVMSPVMPAPVVVRPTPRPAGPPMSPRSSAGCARVFQPAVRVEGFDCLDGGRSGRGHGIAAMV

SEQ ID NO: 2937 - protein, 169 aa, Secale cereale
MSHFAAMKSPVPVAAAAATDAKSPLFCPKPRRPVAPLRCHQSTNSDVGAGMDLLDLLLSKGDESNLSAASPQPPLFCGSPPRRASNPVVHDSRFGVDCPSSPLPWWPVMSPVTPAPVVVRPTPRPAGPPMSPRSSAGCARVFQPAVRVEGFDCLDGGRSGRGHGIAAMV

SEQ ID NO: 2938 - protein, 169 aa, Secale cereale
MSHFAAMKSPVPVAAAAATDAKSPLFCPKPRRPVAPLRCHQSTNSDVGAGMDLLDLLLSKGDESNLSAASPQPPLFCGSPPRRASNPVVHDSRFGVDCPSSPLPWWPVMSPVTAAPVVVRPTPRPVGPPMSPRSSAGCARVFQPAVRVEGFDCLDGGRSGRGHGIAAMV

SEQ ID NO: 2939 - protein, 162 aa, Triticum aestivum
MSHFAAMKSPVPVAAAAATDAKSPLFCPKPRRPVAPLRCHQSSHSDAGAGMDLLDLLLSKGDESNLSAASPQPPLFCGSPPRRASNPVVHDSRFGMDCPSSPLPVTPAPVVVRPTPRPAGPPISPRSSAGCARVFQPAVRVEGFDCLDGGRSGRGHGIAAMV

SEQ ID NO: 2940 - protein, 164 aa, Avena sativa
MSHFAAMKSPVPVAAAATDAKSPLFCPKPRRPVAPLRCHQSDAGMDLLDLLLSKGEESSLSAASPQPPLFCGSPPRRASNPVVHDSRFGMDCPGSPMPWWPVMSPATPAPVAVRPTPRPAPTPMASPRSAAGCARVFQPAVRVEGFDCLDGGRSGRGHGIAAMV

SEQ ID NO: 2941 - protein, 360 aa, Triticum aestivum
GLGRYWGVGGRRCGSCRGSPAAVHCRTCDGGSGDGAYLCAGCGEGHARAGHERVWVCEVCELAPAAVTCKADAAALCAACDADIHHANPLARRHERVPVQPIGSSSPEGQEQEQDAFVMSFGGSVDGEKQQNPVVNLNDALEAGAGGKENVKLDFLFADMMDPFFGSELPRFPHADSVVPSGGAVELDFGGVAAPVVVSNPSYSSYTAASLGGSGSSSEVGLVPDAICGRGGGIIELDFAQSKAAYLPYTPTPSHSTVSSVDVGSVPERSDSAVAAATPATGEGREARLMRYREKRKNRRFEKTIRYASRKAYAESRPRVKGRFAKRADDADTDAVAAATITTPGPCVLDFGSYGVVPTF

SEQ ID NO: 2942 - protein, 337 aa, Pseudoroegneria spicata
  misc_feature (333)..(333): Xaa can be any naturally occurring amino acid
MELQGLGRYWGVGGRRCGSCRASPAAVHCRTCGGGGGDGAYLCAGCDSGHARAGHVRVWVCEVCELAPAAVTCKADAAALCAACDADIHHANPLARRHERVPVQPIGSSSPEGQEQDAFVMSFGGAVDGEKQDPVVNLNDALEVGGGGKDNVKLDFLFADMMDPFFGSELPRFPHADSVVPSGGAVELDFGGVAAAAAVVSNPSYSSYTAASLGGGSGSSSEVGLVPDAICGRGGGIIELDFAQSKAAYLPYTPTPSHSTVSSVDVGSVPERSDSAVAAATPATGEGREARLMRYREKRKNRRFEKTIRYASRKAYAESRPRVKGRFAKRADXADAD

SEQ ID NO: 2943 - protein, 97 aa, Secale cereale
MGDSSSASYIRMVHHLIEKCICFNLNKEGCMEALEKHAKINPVVTSTVWKELEKENKEFFESYNRDRVERNIEAATMERIQKMLSDAAASKSSDDEG

SEQ ID NO: 2944 - protein, 98 aa, Triticum aestivum
MGDSSSASYIRMVHHLIEKCICFNLNKEGCMEALEKHAKINPVVTATVWKELEKENKEFFESYNRDRVERNIEAATMERIQKMLSDAAASKTSDDDEG

SEQ ID NO: 2945 - protein, 100 aa, Setaria italica
MGDSSSSSASYIRMVHHLIEKCICFNLNKEECMDALEKHANVNPVITSTVWKELEKENKEFFETYNKDRVERNIEAETMQRIQKMLAEAAASKTSDDDEG

SEQ ID NO: 2946 - protein, 102 aa, Oryza sativa
MGDSSSSASYIRMVHHLIEKCICFNLNKEECMEALEKHANINPVVTSTVWKELEKENKEFFETYNKDRAERNIEAETMQRIQKMLSDAAASKGSDDDDDDES

SEQ ID NO: 2947 - protein, 99 aa, Panicum virgatum
MGDSSSSSASYIRMVHHLIEKCICFNLNKEECMDALEKHAKINPVITSTVWKELEKENKEFFETYNRDRAERNIEAETMQRIQKMLAEAAASKTSDDES

SEQ ID NO: 2948 - protein, 100 aa, Cynodon dactylon
MGDSSSSASYIRMVHHLIEKCICFNLNKEECMDALEKHANINPVITSTVWKELEKENKEFFETYNKDRVERNIEEETMQRIQKMLSEAAASKTDDDEEEG

SEQ ID NO: 2949 - protein, 98 aa, Panicum virgatum
MGDSSSSASYIRMVHHLIEKCICFNLNKEECMDALEKHAKINPVITSTVWKELEKENKEFFETYNRDRAERNIEAETMQRIQKMLAEAAASKTSDDES

SEQ ID NO: 2950 - protein, 102 aa, Sorghum bicolor
MGDSSSSASYIRMVHHMIEKCICFNLNKEECMDALEKHANVNPVVTATVWKELEKENKEFFETYNKEREERNIIEAETMERIQKMLSEAAASKSSDDDDDDG

SEQ ID NO: 2951 - protein, 99 aa, Brachypodium distachyon
MGDSSSASYIRMVHHLIEKCICFNLNKEECIEALEKHASINPVVTSTVWKELEKENREFFETYQKDRAERKIEAETMQRVQKMLSDAAASRTSDDDDDG

SEQ ID NO: 2952 - protein, 99 aa, Zea mays
MGDSSSSSAAYIKMVHHMIEKCICFNLSKEECMDALEKHANVKPVVTSTVWKELEKENKEFFETYNKDREERKVEAETMARIEKMLSEAAASKSSDDEG

SEQ ID NO: 2953 - protein, 250 aa, Pseudoroegneria spicata
MTKLFDRTFAASPEDAAADAEVSEKIGLLQRFVRPHHLDIPKVLNNEASWLIAVKELQKINSFKSPRDKLLCMMSCCQVINNLLLNVSMTNDRTPSGADEFLPILIYITIKANPPQLHPNLKFVQLFRRETKLVSEVEYYLTNLISAKMFIINVNSHSLSMEESEFQKHMESAKLGTQMSVASPSSPQGLAISTRGLQKQIDAEGSRFPFMDSETENLTPAELKQLHGLYRKTVTRYTLLSKALRKLSID

SEQ ID NO: 2954 - protein, 308 aa, Secale cereale
MESPTSAASRVDFYGFLDRMRRPEAAVLFRSIKSFLASLSLEEPSAEADGARVQAFFAEMEAAIRSHPLWADATHQEIDHALEGLEKYIMTKLFDRTFAASPEDAAADAEVSEKIGLLQRFVRPHHLDIPKVLNNEASWLIAVKELQKINSFKSPRDKLLCMMSCCQVINNLLLNVSMTNDRTPSGADEFLPILIYITIKANPPQLHSNLKFVQLFRRETKLVSEVEYYLTNLISAKMFIINVDGHSLSMEESEFQKHMESAKLGTQMSVAGPSSPQGLATSTSGLQNQIDAEGSRFPFMDSETENLT

SEQ ID NO: 2955 - protein, 350 aa, Panicum virgatum
MESPTSAASRPDFYDFLDRMRRPAAADLFRSIKSFLVSFSFHEPNTEEDGSKVQAFFTEMEGAIRDHPLWANATNQEIDHAIEGLEKYIMTKMFDRTFGASSEDAITDMEISEKISLLQQFVKPHHLDIPKVLHNEASWLLAVKELQKINSFKAPREKLLCIMSCCQVINNLLLNISMSNDRTLSGADEFLPILIYITIKANPPQLHSNLKFVQLFRRETKLVSEVEYYLTNLISAKMFIIDVNARSLSMEESEFQKHMESARLATKISVASPSSSQGLPTYTRAHKEETDLAGCRFPFMDSETESLSPGEVKQLHDLYRQVVTRYTLLSKALRKLSIDEDQLLSSVDDS

SEQ ID NO: 2956 - protein, 532 aa, Triticum aestivum
MAVPTPQRRLLAAAMALLLALASSGAGAVAFAGPIKTVVVVVMENRSFDHMLGWMKRLNPAIDGVTGAEWNPANASDPAAGPRVYFGDGAQFVDPDPGHSYQEIRQQIFGSDDASGPPRMNGFVQQARSIGGGNMTDAVMNGFAPDSVAVYRELVAQFAVCDRWFASVPSSTQPNRLFVHSGTSGGATSNNPELLAKGYPQRTIFDNVHDAGLSFGVYFQDVPAVLFYRNLRKLKYILNFHPFHNAFRDHARRGSLPNYAVIEQHYMDSKDHPANDDHPSHDVYQGQMFVKEIYETLRASPQWNETLMVLTYDEHGGFFDHVPTPVDGVPSPDDIVGPPPYNFTFNRLGVRVPAILISPWIEKGTVMHGPNGSPTPTSQFEHSSIPATVKKLFNLPQDFLTKRDAWAGTFEGVVQTRTEPRTDCPEQLPTPTRIRQTEANEEAKLSSFQQEIVQLAAVLNGDHQLSSLQERIRERMNVREGTSYMRSAVRRFFEAGMSAKRMGLADDEQIVKMRPSLTTRMTSSPADQDDSP

SEQ ID NO: 2957 - protein, 533 aa, Triticum aestivum
MAVPTPQRRLLAAAMALLLVLASSGAVARAGMSGPIKTVVVVVMENRSFDHMLGWMKRLNPAIDGVTGAEWNPANASDPSAGPRVYFGDGAQFVDPDPGHSYQEIRQQIFGSDDATGPPRMNGFVQQARSIGGGNMTDAVMNGFAPDSVAVYRELVAQFAVCDRWFASVPSSTQPNRLFVHSGTSGGATSNNPELLAKGYPQRTIFDNVHDAGLSFGVYFQDVPAVLFYRNLRKLKYILNFHPFHNAFRDHAHRGSLPNYAVIEQHYMDSKDHPANDDHPSHDVYQGQMFVKEIYETLRASPQWNETLMVLTYDEHGGFFDHVPTPVDGVPSPDDIVGPPPYNFTFNRLGVRVPAILISPWIEKGTVMHGPNGSPTPTSQFEHSSIPATVKKLFNLPQDFLTKRDAWAGTFEGVVQTRTEPRTDCPEQLPTPTRIRQTEANEEAKLSSFQQEIVQLAAVLNGDHQLSSLQERIRERMNVREGTSYMRSAVRRFFEAGMSAKRMGLADDEQIVKMRPSLTTRMTSSPADQDDSP

SEQ ID NO: 2958 - protein, 524 aa, Secale cereale
MAVPTPQRRLLALLLVLASSGAVARAGPIKTVVVVVMENRSFDHMLGWMKRLNPAIDGVTGAEWNPANASDPAAGPRVYFGDGAQFVDPDPGHSYQEIRQQIFGSDDASGPPRMNGFVQQATSIGGGNMTEAVMNGFAPDSVAVYRELVAQFAVCDRWFASVPSSTQPNRLFVHSGTSGGATSNNPELLARGYPQRTIFDNVHDAGLSFGVYFQDVPAVLFYRNLRKLKYILNFHPFHNAFRDHARRGSLPNYAVIEQHYMDSKDHPANDDHPSHDVYQGQMFVKEIYETLRASPQWNETLMVLTYDEHGGFFDHVPTPVDGVPSPDDIVGPPPYNFTFNRLGVRVPAILISPWIEKGTVVHGPNGSPTPTSQYEHSSIPATVKKLFNLPQDFLTKRDAWAGTFEGVVQTRTEPRTDCPEQLPMPTRIRQTEANDEAKLSSFQQEIVQLAAVLNGDHQLSSLQERIRERMNVREGTSYMRSAVRRFFEAGMSAKRMGLADDEQIVKMRPSLTTRTSSSVQDDRP

SEQ ID NO: 2959 - protein, 541 aa, Brachypodium distachyon
MAAPPRGPRRRPRPHTLPAAAILVLSLLLLSPPSSSSSAAAGPTSPIKTVVVVVMENRSFDHMLGWMKSLNPAIDGVTGAEWNPANASDPSSPRVYFRDGAQYVDPDPGHSYQEIRQQVFGSDDASGPAKMNGFVQQATSIGGGNMTDAVMHGYKPDAVAVYKELVSQFAVCDRWFASVPSSTQPNRLFVHSGTSGGATSNNPELLAEGYPQRTIFDNIYDAGLSFGVYFQDVPAVLFYRNLRKIKYLLKFHPFHNTFRDHAQSGNLPNYAVVEQHYMDSKSHPANDDHPSHDVYQGQMFIKEIYETLRASPQWNETLMVITYDEHGGFFDHVPTPVDNVPSPDGIVGPPPYNFEFNRLGVRVPTIFISPWIEKGTVVHGPNGSPTPNSQYEHSSIPATVKKLFNLPQDFLTRRDAWAGTFESVVKTRTEPRTDCPETLPMPTRIRQTDANEEAKLSSFQQEIVQLAAVLNGDHQLTSLQERIRDRMNVREGTAYMRRAVRRFFEAGLSAKRMGVANDEQIVKMRPSLTTRTSSDIDQEHP

SEQ ID NO: 2960 - protein, 525 aa, Setaria italica
MAGRTCSARRRSPSLGTAAVLLLLLLLAAWPPRLHAAGPIKTVVVVVMENRSFDHMLGWMKRLNPEIDGVTGAEWNPANTTDPGAGRVYFGEGAQYVDPDPGHSFQEIRQQIFGSDDASGPARMDGFVQQARSLGGNMTDAVMHGFAPDSVAVYRELVAQFAVCDRWFASVPSSTQPNRLFVHSGTSGGATSNNPQLLAKGYPQRTIFDNIHDAGLSFGVYFQDVPAVLFYRNLRKLKYLLDFHPFHPTFRDHARRGSLPNYAVIEQHYLDSKLDPANDDHPSHDVYQGQMFVKEIYETLRASPQWNQTLMVLTYDEHGGFFDHVPTPVNGVPSPDGIVGPPPYNFTFDRLGVRVPAILISPWIEKGTVVHGPNGPTQTSQYEHSSIPATVKKLFDLPQDFLTKRDAWAGTFESVVQTRTEPRTDCPEQLPMPTRIRQTEANEEAKLSEFQQEIIQLASVLNGDHELTSLQDRIRDKMNVREGIAYMRGAVKRYFEAGMSAKRMGVDDEQIVKMRPSLTTRIERP

SEQ ID NO: 2961 - protein, 526 aa, Panicum virgatum
MAVRRRSTCSARAPSLPVAAVVFQFLLLAAAPACLEAGGPIKTVVVVVMENRSFDHMLGWMKRLNPEIDGVTGAEWNPANTTDPAAGRVYFGEGAQYVDPDPGHSFQEIRQQIFGSDDASGPARMDGFVQQARSLGGNMTDAVMHGFAPDSVAVYRELVAQFAVCDRWFASVPSSTQPNRLFVHSGTSGGATSNNPQLLAKGYPQRTIFDNIHDAGLSFGVYFQDVPAVLFYRNLRKLKYLLDFHPFHPSFRDHASRGSLPNYAVIEQHYLDSKLDPANDDHPSHDVYQGQMFVKEIYETLRASPQWNETLMVLTYDEHGGFFDHVPTPVHGVPSPDGIVGPPPYNFTFDRLGVRVPAILISPWIEKGTVIHGPNGPTPTSQYEHSSIPATVKKLFDLPQDFLTKRDAWAGTFESVVQTRTEPRTDCPEQLPMPTRIRQTEANEEAKLSEFQQEIIQLASVLNGDHELTSLQDRIRDKMNVREGIAYMRGAVKRFFEAGMSAKRMGVDDEQIVKMRPSLTTRIERP

SEQ ID NO: 2962 - protein, 526 aa, Panicum virgatum
MAAVRLRRTCSAGRRPRLPAAVLLVLVLLAAPPCLQAGGPIKTVVVVVMENRSFDHMLGWMKRLNPEIDGVTGAEWNPVNTTDPAAGRVYFGEGAQYVDPDPGHSFQEIRQQIFGSDDASGPARMDGFVQQARSLGGNMTDAVMHGFAPDSVAVYRELVAQFAVCDRWFASVPSSTQPNRLFVHSGTSGGATSNNPQLLAKGYPQRTIFDNIHDAGLSFGVYFQDVPAVLFYRNLRKLKYLLDFHPFHPSFRDHASRGSLPNYAVIEQHYLDSKLDPANDDHPSHDVYQGQMFVKEIYETLRASPQWNETLMVLTYDEHGGFFDHVPTPVHGVPSPDGIVGPPPYNFTFDRLGVRVPAILISPWIEKGTVIHGPNGPTPTSQYEHSSIPATVKKLFDLPQDFLTKRDAWAGTFESVVQTRTEPRTDCPEQLPMPTRIRQTEANEEAKLSEFQQEIIQLASVLNGDHELTSLQDRIRDKMNVREGIAYMRGAVKRFFEAGMSAKRMGVDDEQIVKMRPSLTTRIERP

SEQ ID NO: 2963 - protein, 520 aa, Oryza sativa
MAVRRRRPGPVAAAVLLLLAVATQAAASPIKTVVVVVMENRSFDHMLGWMKRLNPEIDGVTGGEWNPTNASDPSSGRVYFGEGAEYVDPDPGHSFQEIRQQIFGSDDASGPARMDGFVQQARSLGDNMTAAVMNGFSPDSVAVYRELVGEFAVFDRWFASVPSSTQPNRLFVHSATSGGATSNNPELLAKGYPQRTIFDNVHDAGLSFGVYYQDVPAVLFYRNLRKLKYLTKFHPFHGAFRDHAARGSLPNYAVVEQHYMDSKSHPANDDHPSHDVFQGQMLVKEVYETLRASPQWNQTLMVVTYDEHGGFYDHVPTPVTGVPSPDGIVGPPPYNFAFDRLGVRVPAIVISPWINKGTVVHGPNGSPTATSEYEHSSIPATVKKLFDLPQDFLTKRDAWAGTFESVVQGRTEPRTDCPEQLPMPMRIRLTEANEEAKLSEFQQELVQLASVLNGDHQLSSLQDTIRDRMNVREGIAYMRGAVKRFFETGMSAKRMGVDDEQIVKMRPSLTTRTSPAIEQP

SEQ ID NO: 2964 - protein, 523 aa, Sorghum bicolor
MAAARARPPPVAALLLLVLLLTGAAGSSTTTSTTSPIKTVVVLVMENRSFDHMLGWMKRLNPEIDGVTGREWNPANTSDPSSGRVYFGDGAAYVDPDPGHSFQEIRQQIFGSDDASGPARMDGFVQQAASIGGGNMTDAVMHGFAPDSVAVYRELVSQFAVCDRWFASVPSSTQPNRLFVHSGTSGGATSNNPTLLAEGYPQRTIFDNLHDAGLSFGVYFQDVPAVLFYRNLRKLKYLLDFHPLRPSFADHARRGVLPNYAVIEQHYLDSKLDPANDDHPSHDVYQGQMLVKYVYETLRASPQWNQTLLVITYDEHGGFFDHVPTPVAGVPSPDGIVGPPPYNFTFDRLGVRVPAILVSPWIDKGTVVHAPTGPTPTSQYEHSSIPATVKKIFNLPQGFLTKRDAWAGTFEGVVQKRTEPRTDCPEQLPTPTRIRQTEADEEAKLSEFQQEIIQLASVLNGDHQLASLQDRIRDEMNVREGIDYMKAAVKRYFEAGASARRMGVDGEQIVKMRPSLTTRIQRP

SEQ ID NO: 2965 - protein, 662 aa, Secale cereale
MGSKRSCLLITYSPEIVDGVPLYVSSNCLPVKASKYEPAGHSFHAVALKLRGLDEKEDTETDDRSVSSDDKSQDFSAGSDNFSSKGKKKSGSGSQQQDHYALLGLGNLRFLATEDQIRKSYRDMALKHHPDKQAALLLHETTEAAKQAKKDEIESHFKAIQEAYEVLMDPTKRRIFDSTDEFDDDIPTDCAPQDFFKVFGPAFMRNGRWSVTQPIPSLGDDSTPVVDVDQFYNFWYNFKSWREFPHEDEYDLEQAESREHKRWMERQNAKIQEKAKKVEYTRVRNLVDNAYRKDPRIQRRKEQEKAEKQRRKEAKYMAKKLQEEEAARAAEEEKKRKEEEAKIAAAAADIRKKLKEKEKKLLRKEKSRLRTLVDPVVKESHFSLSQEDVETVCTSHDVQQLKKLCDIMEDKDTAEKARLLRGALNKEDNSSNTSKEEKIHANGVVGSAPKSTVPQGPPKSTAPQVITLGNCEKKEKQWGKEEIELLRKATLKFPKGTNKRWEVISEFLGTGRSTEEILKATKTVLLQKPDSAKAFDSFLEKRKAAPSIVSPLSTRDETAGGSTVGAGTEPSKAAEQPAASSSQTANEKTGADPVPEEAPSATDPDAWSEAQVLALVQALKAFPKDANQRWERVAASVPGKTVVQCKKKVTSMRSNFRTKKAE

SEQ ID NO: 2966 - protein, 662 aa, Secale cereale
MGSKRSCLLITYSPEIVDGVPLYVSSNCLPVKASKYEPAGHSFHAVALKLRGLDEKEETETDDRSVSSDDKSQDFSAGSDNFSSKGKKKSGSGSQQQDHYALLGLGNLRFLATEDQIRKSYRDMALKHHPDKQAALLLHETTEAAKQAKKDEIESHFKAIQEAYEVLMDPTKRRIFDSTDEFDDDIPTDCAPQDFFKVFGPAFMRNGRWSVTQPIPSLGDDATPVVDVDQFYNFWYNFKSWREFPHEDEYDLEQAESREHKRWMERQNAKIQEKAKKVEYTRVRNLVDNAYRKDPRIQRRKEQEKAEKQRRKEAKYMAKKLQEEEAARAAEEEKKRKEEEAKIAAAAADIRKKLKEKEKKLLRKEKSRLRTLVDPVVKESHFSLSQEDVETVCTSHDVQQLKKLCDIMEDKDTAEKARLLRGALNKEDNSSNTSKEEKIHANGVVGSAPKSTVPQGPPKSTAPQVITLGNCEKKEKQWGKEEIELLRKATLKFPKGTNKRWEVISEFLGTGRSTEEILKATKTVLLQKPDSAKAFDSFLEKRKAAPSIVSPLSTRDETAGGSTVGAGTEPSKAAEQPAASSSQTANEKTGADPVPEEAPSATDPDAWSEAQVLALVQALKAFPKDANQRWERVAASVPGKTVVQCKKKVTSMRSNFRTKKAE

SEQ ID NO: 2967 - protein, 662 aa, Triticum aestivum
MGSKRTCLLITYSPEIVDGVPLYVSSNCLPVKASKYEPAGHSFHAVALKLRGLDEKEDTETDDRSVSSDDKSQDFSAGSDNFSSKGKKKSGSGSQQQDHYALLGLGNLRFLATEDQIRKSYRDMALKHHPDKQAALLLHETTEAAKQAKKDEIESHFKAIQEAYEVLMDPTKRRIFDSTDEFDDDIPTDCAPQDFFKVFGPAFMRNGRWSVTQPIPSLGDDATPVVDVDQFYNFWYNFKSWREFPHEDEYDLEQAESREHKRWMERQNAKIQEKAKKVEYTRVRNLVDNAYRKDPRIQRRKEQEKAEKQRRKEAKYMAKKLQEEEAARAAEEERKRKEEEAKIAAAAADIRKKLKEKEKKLLRKEKNRLRALVGQVIQESHFSLSKEDVETVCTSHDFEQLKKLCDIMEDKDTAEKARLLRGALSKEENSSNTSQEEKIHANGVADSTPKSTVPQGTPKSTAPQVITLGNYEKKEKEWGKEEVELLRKAIHKYPKGTNKRWEVISEFIGTGRSADEILKATKTILLQKPDSAKAFDSFLEKRKAAPSIVSPLSTRDETAGGSTVGTGTEPSKAAEQPAASSSQTAKEKIGADPVLEEAPSATDPDAWSEAQVLALVQALKAFPKDANQRWERVAAAVPGKTVVQCKKKVASMRTNFRTKKAE

SEQ ID NO: 2968 - protein, 663 aa, Brachypodium distachyon
MGSKRSCLLITYSPEITDGIPLYVSSNCLPVKASKYEPAGHSFHAVALKLRGLDEKEDTETDDRSVSSDDKSQDFSAASDTFSSKGKKKSASGSQQQDHYALLGLGNLRFLATEDQIRKSYRDMALKHHPDKQAALLLHEVTEEAKQAKKDEIESHFKAIQEAYEVLMDPTKRRIFDSTDEFDDDIPTDCAPQDFFKVFGPAFMRNGRWSVTQPIPSLGDDTTPVADVDQFYNFWYNFKSWREFPHEDEYDLEQAESREHKRWMERQNAKIQEKAKKVEYARVRNLVDNAFKKDPRIQRRKEEEKAEKQRRREAKYMAKRLQEEEAARAAEEERKRKEEEAKKAAEAALNQKKLREKEKKLLRKEKSRLRALMAPVVADNQFNLSQDDVETACTSLDIEQLKKLCDNMEDKDTTEKARLLRGALSKESSPNTSKEKIQANGVEGSTPKPMPMGGKVPQGNALSGYEKKERPWGKEEVEMLRKATQKYPKGTSRRWEVVSEFIGTGRSVEEILKATKTVLLQKPDSAKAFDSFLEKRKPAPSIVSPLSTRDETVVLQAVGAGTEPSKAAAAEPAAAQPAAASSQTANEKTGADPVPDEAPSATDQDAWSEAQVLALVQALKAFPKDASQRWERVAAAVPGKTVVQCKKKVAAMRSNFRTKKGAE

SEQ ID NO: 2969 - protein, 654 aa, Setaria italica
MEPQKSCLLITYSQEIVDGVPLYVSSNCLPMKALKYEPAGHSFHAAAMKLLGLGEQEDTETDDRSVSSDDKSQDFNTASDTFSSKGKKKSSGSQQQDHYALLGLGHLRFLATEDQIRKSYRDMALKHHPDKQAALILAETTEEAKQAKKDEIESNFKAIQEAYEVLIDPTKRRIYDSTDEFDDDVPTDCAPQDFFKVFGPAFMRNGRWSVTQPIPSLGDDATPVQEVDKFYNFWYNFKSWREFPDDDEYDLEQAESREHKRWMERQNAKLQEKAKKAEYARVRTLVDNAYKKDPRIQRRKDEEKAEKQRRKEAKYLAKKQQEEEAARAAEEERKRKEEEAKKAAEAALNQKKLKEKEKKLLRKEKTRLRTLAAPVVAESNFGLSDEDVETACASLDMEQLKKLCDSMEGKDAAEKAKLLSSALNKESSSKEAKKSDANGVEGSAPKSNSTGGKVTQGSSLLNSYEKKERPWGKEEVELLRKAIQKYPKGTSRRWEVVSEFIGTGRSVEEILKATKTVLLQKPDSTKAFDSFLEKRKPAPTIASPLSTRDETVSSSTDGAGTASSKTAAQPASSQPANGKAAADPVPDAAPSVTDPEAWSETQVLALVQALKAFPKDASQRWERVAAAVPGKTVVQCKKKVAAMRENFRSKKSGE

SEQ ID NO: 2970 - protein, 312 aa, Triticum aestivum
MEGSISGPSEKRVAVVTGGNRGMGLEICRQLAGHGLAVVLTARDDKRGAEAAETLREEGLSDVAFHQLEISEPASAARLAAFVKKKFGKLDILVNNAGVLGVTTDVGDPATLQETLAGKDGMERAEWLRQRTTQTTQDAEDCLRINYHGNKTVTEALLPLLRSSSDGRIVNVTSAWGLLRYFSGDELRRELDDVANLTTQRLDEMSDLFLEDLGKGNGALERRGWPADPVYAAYMASKALVCAYTRVIAREEGAALRVNCVHPGYVLTGMNDYTGVLTAAEGAAAAVAVALAEKGGVTGAYFDRTELGASFV

SEQ ID NO: 2971 - protein, 311 aa, Pseudoroegneria spicata
MEGSIRGPSEKRVAVVTGGNRGMGLETCRQLAAHGLTVVLTARDEKRGAEAAEKLREEGLSDVVFHQLEVSEPGSAARLAAFIKDKFGKLDILVNNAGVLGVTTDVGDPETLQETLAGMDGMERAEWLRQRTTQTTQDAQDCLRINYHGNKTVTEALLPLLRSSSDGRIVNVTSAWGLLRYFSGDELRQELDDVDNLTTQRLDDMSALFLEDLGKGNGALERRGWPADPVYAAYMASKALVCAYTRVLARENAALRVNCVHPGYVLTGMNDYTGVLTAAEGAAAAVAVALTEKGGVTGAYFDRTELGASFV

SEQ ID NO: 2972 - protein, 312 aa, Secale cereale
MEGSTNSPSDKRVAVVTGGNRGMGLEICRQLATHGLTVVLTARDERRGAEAAEKLREEGLLDVLFHQLEISEPASATHLAAFIKDKFGQLDILVNNAGVLGVTTDVGDPATLQETLAGKDGMERAEWLRQRTTQTTKDAEDCLRINYHGNKTVTEALLPLLRSSPDGRIVNVTSAWGLLRYFSGDELRRELDDVANLTTRRLDEMSALFLEDLAKGDGALERRGWPADPVYAAYMASKALVCAYTRVIAREEEGALRVNCVHPGYVLTGMNDYTGVLTAAEGAAAAVAVALAEKGGVTGAYFDRTELGASFV

SEQ ID NO: 2973 - protein, 312 aa, Secale cereale
MEGSTNSPSDKRVAVVTGGNRGMGLEICRQLATHGLAVVLTARDKRRGAEAAEKLREEGLSDVLFHQLDISEPASAAHLAAFIKDKFGQLDILVNNAGVLGVTTDVGDPATLQETLAGKDGMERAEWLRQRTTQTAQDAEDCLRINYHGNKTVTEALLPLLRSSPDGRIVNVTSAWGLLRYFSGDELRRELDDAANLTTRRLDEMSALFLEDLGKGDGALERRGWPADPVYAAYMASKALVCAYTRVLAREEEGALRVNCVHPGYVLTGMNDYTGVLTAAEGAAAAVAVALAEKGGVTGAYFDRTELRASFV

SEQ ID NO: 2974 - protein, 312 aa, Secale cereale
MEGSTNSPSGKRVAVVTGGNRGMGLEICRQLAAHGLAVVLTARDEKRGAEAAEKLREEGLSDVLFHQLDISEPASAAHLAAFIKDKFGQLDILVNNAGVLGVTTDVGDPATLQETLAGKDGMERAEWLRQRTTQTAQDAEDCLRINYHGNKTVTEALLPLLRSSPDGRIVNVTSAWGLLRHFSGDELRRELDDVANLTTRRLDEMSALFLEDLARGDGALERRGWPADPVYAAYMASKALVCAYTRVIAREEEGALRVNCVHPGYVLTGMNDYTGVLTAAEGAAAAVAVALAEKGGVTGAYFDRTELRASFV

SEQ ID NO: 2975 - protein, 311 aa, Secale cereale
MERSTNSPSDKRVAVVTGGNRGIGLEICRQLATHGLAVVLTARDEKRGTEAAEMLREEGLSDVVFHQLEISEPASAAHLAAFIKDKFGKLDILVNNAGVLGVTTDVGDPATLQETLADKDGMERAEWLRQRTTQTTQDAEDCLRINYHGNKTVTEALLPLLRSSSDGRIVNVTSAWGLLRYSAATSSGGAGRRRKPHDAAAGRDVGPVPRGPGQGRWCAGAPRVAGRPGLRAYMASKALVCAYTRVIAREEEGALRVNCVHPGYVLTGMNDYTGVLTAAEGAAAAVAVALAEKGGVTGAYFDRIELGASFV

SEQ ID NO: 2976 - protein, 321 aa, Secale cereale
PCQLKPYSYRTRRRHNGRKHQQPIRQKGRRGDRREPGDRAGDMPAAGSARARRRVDGEGREGRGRLRQPKKLREEGLLDVLFHQLEISQPASAAHLAAFIKDKFGQLDILVNNAGVLGVTTDVGDPATLQETLAGKDGMERAEWLRQRTTQTTKDAEDCLRINYHGNKTVTEALLPLLRSSSDGRIVNVTSAWGLLRYFSGDELRRELDDVDNLTTRRLDEMSALFLEDLGKGDGALERRGCPADPVYAAYMASKALACAYTRVDRQGEEGALRVNCVHPGYVLTGMNDYTGVLTAAEGAAAAVAVALAEKGAHRRLLRPH

SEQ ID NO: 2977 - protein, 593 aa, Triticum aestivum
MAVSAKERKLSRLGSGKAANGGGGGGGSFGARGGHRSPAAGGRRRLFAVFFAFLCAGAVVFGGVHAIGASFRPVLLTAWPSATLNALSSERRVQQAGGNGAGTISPSVQIRHAVALPDHLLVILGDGSLLPAPGHFECLYSTANSTQLRRRPLSVAALPDGPSLVHCPAGPSGMAVSLSLSQSPPVTPFQWDQLVYTALLDSRDNSTVVFAKGMNLRPGRLGVPSRYECVFGRDLSKPKLVVTSPVVSAAQETFRCVTPVRIRRYLRMTADGNINRNSAGKPMLVSIRTKGRGSSTLPSIAQPEPLPRYNRHRHTRHRQQKAHSMCVCTMLRNQARFLREWIMYHSHIGVQRWFIYDNNSDDGIEEVLGSMDPSAYNATRHLWPWMKSQEAGFAHCALRARESCEWVGFIDIDEFLHFPGNQTLQDVLRNYSSRPRIGELRTACHSFGPSGRTKIPKKGVTTGYTCRLAAPERHKSIVRPDALNPSLINVVHHFHLKEGMKYVNVGQGVMLINHYKYQVWEVFKEKFAGRVATYVADWQDEENVGSRDRAPGLGTKPVEPEDWPSRFCEVYDTGLKDFVHKEFTDPQTGSLPW

SEQ ID NO: 2978 - protein, 590 aa, Secale cereale
MAVSAKERKLSRLGSGKAANGGGGSFGARGGHRSPGAGGRRRLFAVFFAFLCAGAVVFGGVHAIGASFRPVLLTAWPSATLNALSSERRVQQAGGNGAGTISPSVQIRHAVALPDHVLVVLGDGSLLPAPGHFECLYSTANSTQLRRRPLSVAALPDGPSLVHCPAGPSGMAVSLSLSQSPPVTPFQWDQLVYTALLDSRDNSTVVFAKGMNLRPGRLGVPSRYECVFGRDLSKPKFVVTSPVVSAAQETFRCVTPVRIRRYLRMTADGNINKNSDGKPMLVSIRTKGRGSSTLPSIAQPEPLPRYTRHRHTRHRQQKVHSMCVCTMLRNQARFLREWIMYHSHIGVQRWFIYDNNSDDGIEEVLGSMDPSAYNVTRHLWPWMKSQEAGFAHCALRARESCEWVGFIDIDEFLHFPGNQTLQDVLRNYSSRPRIGELRTACHSFGPSGRTKVPKKGVTTGYTCRLAAPERHKSIIRPDALNPSLINVVHHFHLKEGMKYANVGQGVMLINHYKYQVWEVFKEKFAGRVATYVADWQDEENVGSRDRAPGLGTKPVEPEDWPRRFCEVYDTGLKDFVHKEFTDPQTGSLPW

SEQ ID NO: 2979 - protein, 591 aa, Triticum aestivum
MAISAKERKLSRLGSGKAVNGGGGGSLGARGGHRPPTAGGRRRLFAVFFAFLCAGAVVFGGVHAIGASFRPVLLTAWPSATLNALSSERRVQQAGGNGAGTVLASVQIRHAVALPDHVLVILSDGSLLPAPGHFECLYSTANSTQLRRRPLSVAALPDGPSLVHCPAGPSEMAVSLSLSQSPPVTPFQWDQLVYTALLDSRDNSTVVFAKGMNLRPGRLGVPSRYECVFGRDLSKPKLVVTSPVVSAAQETFRCVTPVRIRRYLRMTADGNINRNSDGKPMLVSIRTKGRGSSTLPSIAQPEPLHRYNRHRHTRHRQQKVHSMCVCTMLRNQARFLREWIMYHSHIGVQRWFIYDNNSDDGIEEVLGSMDPSTYNVTRHLWPWMKSQEAGFAHCALRARESCEWVGFIDIDEFLHFPGNQTLQDVLRNYSSRPRIGELRTACHSFGPSGRTKIPKKGVTTGYTCRLAAPERHKSIVRPDALNPSLINVVHHFHLKEGMKYANVGQGVMLINHYKYQVWEVFKEKFAGRVATYVADWQDEENVGSRDRAPGLGTKPVEPEDWPSRFCEVYDTGLKDFVHKEFTDPQTGSLPW

SEQ ID NO: 2980 - protein, 584 aa, Oryza sativa
MALAAKERKLSRLGSKGSGGGGGGGSFGARGQRAPAGTQRRLFAAFFAFLFAGAVLFGAAHVIGASFRPVLKTAWPSATLNAVSSERGAQQAGMVSVDAVLPSVHIQHAVALPDHVLLMLRDGSLLPASGQFECLYSPVNSSQLRRQPLSVATLPDGPSLVHCPAGPSRVAVSLSLAQSVPVAPLQWDRLVYTALIDSKDNSTVVFAKGMNLRPGRLGVPSRYECVFGRDFSKPKLVVTSPVVSAAQEIFRCVTPVRIRRYLRMTTGGKNSVNNDDKPMLVSIRTKGRGSSTLPSIAQPEPLPRYNKHWRRKAHSMCVCTMLRNQARFLREWIIYHSRIGVQRWFIYDNNSDDGIEEVLNTMDSSRYNVTRYLWPWMKSQEAGFAHCALRARESCEWVGFIDIDEFLHFPGNQTLQDVLRNYSVKPRIGELRTACHSFGPSGRTKIPKKGVTTGYTCRLAAPERHKSIVRPDALNPSLINVVHHFHLKEGMKYVNIGQGMMLINHYKYQVWEVFKDKFSGRVATYVADWQDEENVGSRDRAPGLGTKPVEPEDWPRRFCEVYDNGLKDFVQKVFTDPHTGNLPW

SEQ ID NO: 2981 - protein, 585 aa, Brachypodium distachyon
MAMSAKERKLSRLGSGKGPSGARGGGQQRTPPAGSRRRLFAAFFAFLCAGAVLLGGAHVIGASFRPVLLTAWPSATLNAVSSERGAQQAGSGGAVLPSVQVRHAVALPDHVLLILRDDGSLLLASRQFECLYSVANSTQLRQLPLSVASLPGGPNLVHCPAGPAGAAVSLSLSEWPPVVPLEWDRLAYTALIDSRDNSTVVFAKGMNLRPGRLGVPSRYECVFGRDLSKPKFVVTSPVVSAAQETFRCVTPARIRRYLRMTSDDYGASNCGDKPMLVSVRTKGRGSSTLPSIAHPEPLPRYNRHRRNRHRQRKAHSMCVCTMLRNQARFLREWIMYHSHVGVQRWFIYDNNSDDDIEQVLNTMDPARYNVTRYLWPWMKSQEAGFAHCALRARESCEWVGFIDIDEFLHFPGNQTLQAVLRNYSSRPQIGELRTSCHSFGPSGRTKIPRKGVTTGYTCRLAAPERHKSIVRPDALNPSLINVVHHFHLKEGIKYANIGQGVMLINHYKYQVWEVFKDKFSGRVATYVADWQDEENVGSRDRAPGLGTKPVEPEDWPSRFCEVYDTGLKDFVHKEFTDPQTGNLPW

SEQ ID NO: 2982 - protein, 588 aa, Sorghum bicolor
MAMSAKERKLSRLGSCKVTSAAGSGGGGGGSPAARGHRSPAAPQRRVFAALFAFLCAGVVVLGGVHVIGASFRPVLRTAWPSATLNAISSDARAQQAGSTADAVLPSVQIQHAVAFPDRVLLILKDGSSLPAPQRFECLYSPANSSELRRQPLLAASLPDGPSLVHCPAEPSGVDVSLSLSLSPPVAPLQWDRLVYTALVDSRDNSTIVFAKGMNLRPGRLGVASRYQCVFGRDLSKPKHVLTSPVISAAQEIFRCVTPVRIRRYLRMTTNPNGNGDSDDKPMLVSIRTKGQRDSTLPSIAEPEPLPRYNRHRRQKAHSMCVCTMLRNQARFLREWIIYHSHIGVERWFIYDNNSDDDIEQALGTMDPSRYNVTRHLWPWMKSQEAGFAHCALRARESCEWVGFIDIDEFLHFPGNKTLQDILRNYSNRPRIGELRTACHSFGPSGRTKIPKKGVTTGYTCRLAAPERHKSIVRPDALNPSLINVVHHFHLKEGVRYVNLGQGVMLINHYKYQVWEVFKDKFSGRVATYVADWQDEENVGSRDRAPGLGTKPVEPEDWPRRFCEVFDTGLKDFVHKAFTDPATGSLPW

SEQ ID NO: 2983 - protein, 586 aa, Setaria italica
MAMSAKERKLSRLGSCKGSPAAGGSGGSPAARGHRSPAAGPQRRLFAALFAFLCAGVVVLGGVHVIGASFRPVLRTAWPSGTLSAISSDAGARQAGVGADTVLPSVQIRHAVAFPDRVLLILKNGSSLPAPEQFECLYSPANSSELRHQALLAVSLPDGSSVVHCPAEPSGVDVSLSLSLSPPVAPLQWDRLVYTALVDSRDNSTVVFAKGMNLRPGRLGVASRYQCVFGRDLSKPKHVLTSPLISAAQEIFRCVTPVRIRRYLRMSMDANGNGDSDDKPMLVSIRTKGLRDSTLPSIAEPEPLPRYKRHRRQKAHSMCVCTMLRNQARFLQEWIIYHSHIGVERWFIYDNNSDDDIEQVLNTMDPSRYNVTRHLWPWMKSQEAGFAHCALRARESCEWVGFIDVDEFLHFPGNQTLPDILQNYSNRPRIGELRTACHSFGPSGRTKIPKKGVTTGYTCRLAAPERHKSIVRPDALNPSLINVVHHFHLKEGVRYVNIGQGVMLINHYKYQVWEVFKDKFSGRVATYVADWQDEENVGSRDRAPGLGTKPVEPEDWPHRFCEVYDTGLKDFVHKAFTDPDTGSLPW

SEQ ID NO: 2984 - protein, 589 aa, Panicum virgatum
MVMSAKERKLSRLGSCKVAGGGGGGSPAARGHRSAAAAASAAGPQRRLFAALFAFLCAGVVVIGGVHVIGASFRPVLRTAWPSGTLNAISSDTGAQQAGGGDDTVLPSVQIQHAVGFPDRVLLILKDGSSLPAPERVECLYSPANSSELRRRALLAVSSPDGSSLVHCPAEPSGVDVSLSLSLSPPVAPLHWDRLVYTALVDSRDNSTVVFAKGMNLRPGRLGVASRYQCVFGRDLSKPKHVLTSPVISAAQEIFRCVTPARIRRYLRMSTDARRNGDTDDKPMLVSIRTKGQRDSTLPSIAEPEPLPRYNRHRRQKAHSMCVCTMLRNQARFLREWIIYHSHIGVERWFIYDNNSDDDIEQVLNTMDPSRYNVTRHLWPWMKSQEAGFAHCALRARESCEWVGFIDVDEFLHFPGNQTLADILQNYSNRPRIGELRTACHSFGPSGRTKIPKKGVTTGYTCRLSAPERHKSIVRPDALNPSLINVVHHFHLKEGARYVNIGQGVMLINHYKYQVWEVFKDKFSGRVATYVADWKDEENVGSRDRAPGLGTKPVEPEDWPSRFCEVYDTGLKDFVHKAFTDPDTGSLPW

SEQ ID NO: 2985 - protein, 536 aa, Panicum virgatum
MVMSAKERKLSRLGSCKVAGGGGGGSPAARGHRSAAAAASAAGPQRRLFAALFAFLCAGVVVIGGVHVIGASFRPVLRTAWPSGTLNAISSDTGAQQAGGGDDTVLPSVQIQHAVGFPDRVLLILKDGSSLPAPERVECLYSPANSSELRRRALLAVSSPDGSSLVHCPAEPSGVDVSLSLSLSPPVAPLHWDRLVYTALVDSRDNSTVVFAKGMNLRPGRLGVASRYQCVFGRDLSKPKHVLTSPVISAAQEIFRCVTPARIRRYLRMSTDANRNGDTDDKPMLVSIRTKGQRDSTLPSIAEPEPLPRYKRHRRQKAHSMCVCTMLRNQARFLREWIIYHSHIGVERWFIYDNNSDDDIEQVLNTMDPSRYNVTRHLWPWMKSQEAGFAHCALRARESCEWVGFIDVDEFLHFPGNQTLADILQNYLNRPRIGELRTACHSFGPSGRIKIPKKGVTTGYTCRLSAPERHKSIVRPDALNPSLINVVHHFHLKEGVRYVNIGQGVMLINHYKYQVWEVFKDKFSGRVATYVADWKG

SEQ ID NO: 2986 - protein, 589 aa, Panicum virgatum
MSAKERKLSRLGSCKVVAVAGGSGGGGLGSPAARGHRSAAAAGPQRRLFAALFAFLCAGVVVIGGVHVIGASFRPVLRTAWPSGTLNAISSDAGAQQAGGSADTVLPSVQIRHAVGFPDRVLLILKDGSSLPAPERVECLYSPANSSELRRRALLAVSSPDGSSLVHCPAEPSGVDVSLSLSLSPPVVPLHWDRLVYTALVDSRDNSTVVFAKGMNLRPGRLGVASRYQCVFGRDLSKPKHVLTSPVISAAQEIFRCVTPARIRRYLRMSTDANRNGDTDDKPMLVSIRTKGQRDSTLPSIAEPEPLPRYKRHRRQKAHSMCVCTMLRNQARFLREWIIYHSHIGVERWFIYDNNSDDDIEQVLNTMDPSRYNVTRHLWPWMKSQEAGFAHCALRARESCEWVGFIDVDEFLHFPGNQTLADILQNYLNRPRIGELRTACHSFGPSGRIKIPKKGVTTGYTCRLSAPERHKSIVRPDALNPSLINVVHHFHLKEGVRYVNIGQGVMLINHYKYQVWEVFKDKFSGRVATYVADWKDEENVGSRDRAPGLGTKPVEPEDWPSRFCEVYDTGLKDFVHKAFTDPDTGSLPW

SEQ ID NO: 2987 - protein, 838 aa, Triticum aestivum
MMGRRKLQVVTLAILCFWSSAGAQTVDFKPADSYLVDCGSAKGTTVLGRDFAADGASPVTVSTSQDILAGTSANGVSSFDNPVLYQTARIFTSPSSYTFPIQKQGRHFVRLYFYPFIYQSYDLSTAKFTVSTQDVLLLSDFQQPDKTAPLFKEYSLNITRDQLVISFKPSNGIAFINAIEVVSVPDDLIADVANMVNPVQQYSGLTTQSLETVYRVNMGGPKVFPNNDTLSRTWQKDQKYILNPSVTKTAQYGKAIKYRKGGATPLTAPDIVYSTATELAASNTSNALFNMTWQFDVDAGFSYLIRFHFCDIVSKALNQLYFNAYVGGFFAQHDLDLSEQSVNQLATAIYVDVVLSSNDASSKLSISIGPSTLNNALPDGILNGLEIMKMGSGSGSAFTVGNNGSNKKLPIIIGSVLGVVGLLIIVLVVVLLCRRKKTDDKQHSKTWMPFSINGLTSLSTGSRTSYGTTLTSGLNGSYGYRFAFNVLQEATNNFDESWVIGVGGFGKVYKGALRDDTKVAVKRGNPKSQQGLNEFRTEIELLSRLRHRHLVSLIGYCDERNEMILVYEYMENGTVKSHLYGSDNPSLNWKQRLEICIGAARGLHYLHTGSAKAIIHRDVKSANILLDENLLAKVADFGLSKTGPELDQTHVSTAVKGSFGYLDPEYFRRQQLTEKSDVYSFGVVMLEVLCARPVIDPSLPREMVNLAEWGMKWQKRGELHQIVDQKLSGAIRPDSLRKFGETVEKCLADYGVERPSMGDVLWNLEYVLQLQDVDSSTVSDVNSMNRIVDLSSQVQHVGAMESISVTMAEDGALHEPDHDLSDVSMSRVFSQLIKAEGR

SEQ ID NO: 2988 - protein, 344 aa, Secale cereale
MMGRRKLQVVTLAILCFWSSAGVCKAQTVDFKPADNYLVDCGSTKGTTVLGRDFAADGASPVTVSTSQDILAGTSANGVSSFDNPVLYQTARIFTGPSSYTFPIQKQGRHFVRLYFYPFIYQSYDLSTAKFTVSTQDVLLLSDFQQPDKTAPLFKEYSLNITRDQLVISFKPSNGIAFINAIEVVSVPDDLIADVANMVNPVQQYSGLTTQSLETVYRVNMGGPKVFPSNDTLSRTWQKDQKYILNPSVTKTAVYGKPINYRKGGATPLTAPDIVYSTATELAASNTSNALFNMTWQFDVDAGFSYLIRFHFCDIVSKALNGIDIMHMWEASLHSMILISQSNR

SEQ ID NO: 2989 - protein, 728 aa, Brachypodium distachyon
MLGRRRKLQSAALLVFYFCSSAGIICRAQLDQFKPADSYLVDCGSAKGTTVTERNFAADGASPVTVSTSQEILAGTSANGVSSFDNSALYQTARIFTSPSSYTFPINKQGRHFVRLYFFPFIYQSYDLSSAKFTVSTQDVLLLSDFQQPDKTAPLFKEYSLNITRDNLIISFKPSNGIAFINAIEVVSVPDDLIADVAQMVNPVQQYSGLSTQSLETVYRVNMGGPKVTANNDTLSRTWLSDQKFILNPSVTKKVVYGKAIKYKNGGATPLTAPDIVYGTATELAASNTSNALFNMTWQFDVDAGFSYLIRFHFCDIVSKALNQLYFNAYVGGFFAQHDLDLSEQSMNQLATAIYVDVVLSSNDASSKLSISIGPSTLNNAFPDGILNGLEVMKMGSGSGSAFTVGSSGAKKNLVVITGSVLGVIGLLVIILVLVLLCRRKKTDDKTHSKTWMPFSINGLTSLSTGSRTSYGTTLTSGLNGSFGYRFAFNVLQEATNNFDENWVIGVGGFGKVYKGVLRDDTKVAVKRGNPKSQQGLNEFRTEIELLSRLRHRHLVSLIGYCDERNEMILVYEYMENGTVKSHLYGSDNPSLNWKQRLEICIGAARGLHYLHTGSAKAIIHRDVKSANILLDENFLAKVADFGLSKTGPELDQTHVSTAVKGSFGYLDPEYFRRQQLTEKSDVYSFGVVMLEVLCARPVIDPTLPREMVNQRRVGNEMAEERRVASDR

SEQ ID NO: 2990 - protein, 842 aa, Oryza sativa
MVALSGRKRRLQAATMVALCFLSSICVSTAQFKPADNYLVDCGSSKSTTLGTRTFAADGAAPVKVDTSLEILAGTSANGVASFDNSALYQTARIFTSPSSYTFPIQKQGRHFVRLYFFAFAYQSYDLSTAKFTVSTQEMLLLSDFQQPDKTAPLFKEYSLNITQDKLIISFKPSNGIAFINAIEVVSVPDDLIGDSAPMVNPMQQYSGLSTQPLETVYRVNMGGPKVTADNDTLSRTWVTDKKYLVNPSVTREVNGGKVNYMKGGGSTPLIAPDIVYSTATELAASNTTNALFNMTWQFDVDSGFSYLIRFHFCDIVSKALNQLYFNAYVGSFYAQHDIDLSIQSMNQLATAIYLDVVLSSNDASNKLSISIGPSTLNNALPDGILNGLEVMKMSSGSGSAFTVGSSGSNKNLGVIIGSVLGAVGILIIVLVIVLLCRKKKTLEKQHSKTWMPFSINGLTSLSTGSRTSYGTTLTSGLNGSYGYRFAFSVLQEATNNFDENWVIGVGGFGKVYKGVLRDDTKVAVKRGNPKSQQGLNEFRTEIELLSRLRHRHLVSLIGYCDERNEMILVYEYMEKGTLKSHLYGSDNPSLNWKQRLEICIGAARGLHYLHTGSAKAIIHRDVKSANILLDENLLAKVADFGLSKTGPELDQTHVSTAVKGSFGYLDPEYFRRQQLTEKSDVYSFGVVLLEVLCARPVIDPTLPREMVNLAEWGMKWQKRGELHQIVDQRVSGSIRPDSLRKFGETVEKCLADYGVERPSMGDVLWNLEYVLQLQDADSSTVSDVNSMNRIVELPSQVQNIGALESISVTMAEAGASHEPDHDLSDVSMSRVFSQLIKAEGR

SEQ ID NO: 2991 - protein, 840 aa, Setaria italica
MMAPSGRKRPPAATTFILLCILSSLCVCKAQFKPADSYLVDCGSPKSTTVGQRTFASDGASPVKVSTSQEILAGTSANGVASFDNSALYQTARIFTSPSSYTFPIQKQGRHFIRLYFFPFTYQSYDLALAKFTVSTQDVLLLSDFQQPDKTAPLFKEYSLNITRDTLVISFKPSNGIAFINAIEVVSVPDDLIVDAAQMVNPMQQYSGLSAQPLETVYRVNMGGPKVTPDNDTLSRTWVTDQKYLLNPTVTKKFAYGKDVNYKKGGATQLTAPDIVYGTVTELAASNTSNALFNMTWQFDVDAGFSYLIRFHFCDIVSKALNQLYFNAYVGGFFAQNNLDLSVMSDNQLATATYIDVVLSSNDASSKLGISIGPSTLNNVLPDGILNGLEVMKISTGGSAFTVGSGTGNKNLGVILGAVLGGAGLLIIIVVLVLLCRKKKTLEKQHSKTWMPFSINGLTSLSTGSRTSYGTTLTSGLNGSYGYRFAFSVLQEATNNFDENWVIGVGGFGKVYKGVMRDETKVAVKRGNPKSQQGLNEFRTEIELLSRLRHRHLVSLIGYCDERNEMILVYEYMEKGTLKSHLYGSDNPSLNWKQRLEVCIGAARGLHYLHTGSAKAIIHRDVKSANILLDENLLAKVADFGLSKTGPELDQTHVSTAVKGSFGYLDPEYFRRQQLTEKSDVYSFGVVLLEVLCARPVIDPTLPREMVNLAEWGMKWQKRGELHQIVDQRISGTIRPDSLRKFGETVEKCLADYGVERPSMGDVLWNLEYVLQLQDADSTVSDVNSMNRIVELPSQVQNVGALESISVTMAEAGASNDPDHDLSDVSMSRVFSQLIKAEGR

SEQ ID NO: 2992 - protein, 839 aa, Panicum virgatum
MMAPSGRTRPQAATTFILLCILSSYCICKAQFKPADSYLVDCGSSKSTTVGQRTFASDGASPVKVSTSQEILAGTSANGVASFDNSALYQTARIFTSPSSYTFPIQKQGRHFVRLYFFPFTYQSYDLSLAKFTVSTQDVLLLSDFQQPDKTAPLFKEYSLNITRDTLIISFKPSNGIAFINAIEVVSVPDDLIVDNAQMVNPMQQYSGLSTQPLETVYRVNMGGPKVTPDNDTLSRTWVTDKKYLLNPTMTKQAIGKDVNYKKGGATQLTAPDIVYSTATELAASNTSNALFNMTWQFDVDAGFSYLIRFHFCDIVSKALNQLYFNAYVGGFSAQNNLDLSVLSDNQLATAIYIDVVLSSNDASSKLGISIGPSTLNNVLPDGILNGLEVMKISTGGSAFTVGSGGGKKNLAVILGAVLAAVGLLIIVVVLILFCRKKKTLEKQHSKTWMPFSINGLTSLSTGSRTSYGTTLTSGLNGSYGYRFAFSVLQEATNNFDENWVIGVGGFGKVYKGVLRDETKVAVKRGNPKSQQGLNEFRTEIELLSRLRHRHLVSLIGYCDERNEMILVYEYMEKGTLKSHLYGSDNPSLNWKQRLEVCIGAARGLHYLHTGSAKAIIHRDVKSANILLDENLLAKVADFGLSKTGPELDQTHVSTAVKGSFGYLDPEYFRRQQLTEKSDVYSFGVVLLEVLCARPVIDPTLPREMVNLAEWGMKWQKRGELHQIVDQRISGTIRPDSLRKFGETVEKCLADYGVERPSMGDVLWNLEYVLQLQDVDSTVSDVNSMNRIVELPSQVQNVGALESISVTMAEAGASNEPDHDLSDVSMSRVFSQLIKAEGR

SEQ ID NO: 2993 - protein, 838 aa, Panicum virgatum
MMAPSGRKRPQAATTFILLFILSSFCICKAQFKPADSYLVDCGSSKSTTVGQMTFASDGASPVKVSTSQEILAGTSANGVASFDNSALYQTARIFTSPSSYTFPIQKQGRHFVRLYFFPFTYQSYDLSLAKFTVSTQDVLLLNDFQQPDKTAPLFKEYSLNITRDTLVISFKPSNGIAFINAIEVVSVPDDLIVDAAQMVNPVQQYSGLSTQPLETVYRVNMGGPKVTPDNDTLSRTWVTDKKYLLNPTVTKQVVGNVNYKKGGATQLTAPDIVYGTAAELAASNTSNALFNMTWQFDVDAGFSYLIRFHFCDIVSKALNQLYFNAYVGGFSAQNNLDLSVMSDNQLATAIYIDVVLSSNDASSKLSISIGPSTLNNVLPDGILNGLEVMKISTGGSAFTVGSGGGNKNLGVVLGAVLGAVGLLILVVVLILFCRKKKTLEKQHSKTWMPFSINGLTSLSTGSRTSYGTTLTSGLNGSYGYRFAFSVLQEATNNFDENWVIGVGGFGKVYKGVLRDETKVAVKRGNPKSQQGLNEFRTEIELLSRLRHRHLVSLIGYCDERNEMILVYEYMEKGTLKSHLYGSDNPSLNWKQRLEVCIGAARGLHYLHTGSAKAIIHRDVKSANILLDENLLAKVADFGLSKTGPELDQTHVSTAVKGSFGYLDPEYFRRQQLTEKSDVYSFGVVLLEVLCARPVIDPTLPREMVNLAEWGMKWQKRGELHQIVDQRISGTIRPDSLRKFGETVEKCLADYGVERPSMGDVLWNLEYVLQLQDADSTVSDVNSMNRIVELPSQVQNVGALESISVTMAEAGASNEPDHDLSDVSMSRVFSQLIKAEGR

SEQ ID NO: 2994 - protein, 840 aa, Pennisetum glaucum
MMVPTGRKRPPAATTFILLCILSSFCVCKGQFKPADSYLVDCGSSKSTTVGQRTFASDGASPVKVTTSQDILAGTSANGVASFDNSALYQTARIFTSPSSYTFPIQKQGRHFVRFYFFPFTYQSYDLSLAKFTVSTQDVLLLSDFQQPDKTAPLFKEYSLNINRDTLVISFKPSNGIAFINAIEVVSVPDDLIADAAQMVNPMQQYTGLSAQPLETVYRVNMGGPKVTPDNDTLSRSWVNDQKYLLNPTVTDTVRYGKPVNYKKGGATQLTAPDIVYSTATELAASNTSNALFNMTWQFDVDAGFSYLIRFHFCDIVSKALNELYFTAYVGAFSAQSNIDLSVMSENHLATAAYIDVVLSSNDASSKLGISIGPSTLNNVLPKGILNGLEVMKISTGGSAFTVGSGSGNKNLGVILGAALGGVGLLIIIVVLVLLCRKKKTLEKQHSKTWMPFSINGLTSLSTGSRTSYGTTLTSGLNGSYGYRFAFSVLQEATNNFDENWVIGVGGFGKVYKGVLRDETKVAVKRGNPKSQQGLNEFRTEIELLSRLRHRHLVSLIGYCDERNEMILVYEYMEKGTLKCHLYGSDNPSLNWKQRLEVCIGAARGLHYLHTGSAKAIIHRDVKSANILLDENLLAKVADFGLSKTGPELDQTHVSTAVKGSFGYLDPEYFRRQQLTEKSDVYSFGVVLLEVLCARPVIDPTLPREMVNLAEWGMKWQKRGELHQIVDQRISGTIRPDSLRKFGETVEKCLADYGVERPSMGDVLWNLEYVLQLQDADSTVSDVNSMNRIVELPSQVQNVGALESISVTMAEAGASNEPDHDLSDVSMSRVFSQLIKAEGR

SEQ ID NO: 2995 - protein, 734 aa, Secale cereale
GRHFVRLYFYPFIYQSYDLSTAKFTVSTQDVLLLSDFQQPDKTAPLFKEYSLNITRDQLVISFKPSNGIAFINAIEVVSVPDDLIADVANMVNPVQQYSGLTTQSLETVYRVNMGGPKVFPSNDTLSRTWQKDQKYILNPSVTKTAVYGKPINYRKGGATPLTAPDIVYSTATELAASNTSNALFNMTWQFDVDAGFSYLIRFHFCDIVSKALNQLYFNAYVGGFFAQHDLDLSEQSVNQLATAIYVDVVLSSNDASSKLSISIGPSTLNNALPDGILNGLEIMKMGSGSGSAFTIGDNGSNKKLPIIIGSVLGVVGLLIIVLVVVLLCRRKKTDDKQHSKTWMPFSINGLTSLSTGSRTSYGTTLTSGLNGSYGYRFAFNVLQEATNNFDESWVIGVGGFGKVYKGALRDDTKVAVKRGNPKSQQGLNEFRTEIELLSRLRHRHLVSLIGYCDERNEMILVYEYMENGTVKSHLYGSDNPSLNWKQRLEICIGAARGLHYLHTGSAKAIIHRDVKSANILLDENLLAKVADFGLSKTGPELDQTHVSTAVKGSFGYLDPEYFRRQQLTEKSDVYSFGVVMLEVLCARPVIDPSLPREMVNLAEWGMKWQKRGELHQIVDQKLSGAIRPDSLRKFGETVEKCLADYGVERPSMGDVLWNLEYVLQLQDADSSTVSDVNSMNRIVDLSSQVQHVGAMESISVTMAEDGALHEPDHDLSDVSMSRVFSQLIKAEGR

SEQ ID NO: 2996 - protein, 842 aa, Zea mays
MMATLGRKKRQAATTFIVLCILSSFYICKAQFTPADSYLVDCGSSKSTMVGQRTFTADGASPVKVSTSQDILAGTSANGVASFDNSALYQTARIFTGPSSYTFPIQKQGRHFVRFYFFPFTYQSYDLSLAKFTVSTQDVLLLSDFQQPDKTAPLFKEYSLNITRDTLVISFKPSNGIAFVNAIEVVSVPDDLITDDAQMVNPVQQYSGLSTQPLETVYRVNMGGPKVTPDNDTLSRTWVTDLKYLLNPSVTKQVNYGKRVNYKKGGGGATQLSAPDIVYGTATELAATNTSNALFNMTWQFDVDAGFSYLVRFHFCDIVSKALNQLYFNAYVGGFYAQNNLDLSAMSDSQLATPIYIDVVLSSNDASSKLSISIGPSVLNNVLPDGILNGLEVMKISTGGSAFTVGSGSGNKKWGVILGAALGGVGLFIIVVVLVLLCRRKKTLEKQHSKTWMPFSINGLTSLSTGSRTSYGTTLTSGLNGSYGYRFAFSVLQEATNNFDENWVIGVGGFGKVYKGVMRDESKVAVKRGNPKSQQGLNEFRTEIELLSRLRHRHLVSLIGYCDERNEMILVYEYMEKGTLKSHLYGSDNPSLNWKQRLEVCIGAARGLHYLHTGSAKAIIHRDVKSANILLDENLLAKVADFGLSKTGPELDQTHVSTAVKGSFGYLDPEYFRRQQLTEKSDVYSFGVVLLEVLCARPVIDPTLPREMVNLAEWGMKWQKRGELHQIIDQRISGTIRPDSLRKFGETVEKCLADYGVERPSMGDVLWNLEYVLQLQDADSTVSDVNSMNRIVELPSQVQNVGALESISVTMAEAGASNEPDHDLSDVSMSRVFSQLIKAEGR

SEQ ID NO: 2997 - protein, 841 aa, Sorghum bicolor
MMATLGRKKWQAVTTFIVLCILSSICICKAQFKPADSYLVDCGSSKSTMVGQRTFAADGASPVKVSTSQDILAGTSANGVASFDNSALYQTARIFTGPSSYTFPIQKQGRHFVRFYFFPFTYQSYDLSLAKFTVSTQDVLLLSDFQQPDKTAPLFKEYSLNITRDTLVISFKPSNGIAFVNAIEVISVPDDLIADNAQMVNPVQQYTGLSTQPLETVYRVNMGGPKVTPDNDTLSRTWVTDGKYLLNPAVTKNVLYGKDVNYKKGLATQLTAPDIVYGTATELAASSNTSNAVFNMTWQFDVDAGFSYLVRFHFCDIVSKALNQLYFNAYVGGFSAQTNLDLSTMSESQLATPVYIDVVLSSNDASSKLGISIGPSTLDNVLTDGILNGLEVMKISTGGSAFTVGSGSGNKNWGVILGAALGGVGLFIIVVVLVLLCRRKKTLEKQHSKTWMPFSINGLTSLSTGSRTSYGTTLTSGLNGSYGYRFAFSVLQEATNNFDENWVIGVGGFGKVYKGVMRDETKVAVKRGNPKSQQGLNEFRTEIELLSRLRHRHLVSLIGYCDERNEMILVYEYMEKGTLKSHLYGSDNPSLNWKQRLEVCIGAARGLHYLHTGSAKAIIHRDVKSANILLDENLLAKVADFGLSKTGPELDQTHVSTAVKGSFGYLDPEYFRRQQLTEKSDVYSFGVVLLEVLCARPVIDPTLPREMVNLAEWGMKWQKRGELHQIIDQRISGTIRPDSLRKFGETVEKCLADYGVERPSMGDVLWNLEYVLQLQDADSTVSDVNSMNRIVELPSQVQNVGALESISVTMAEAGASNEPDHDLSDVSMSRVFSQLIKAEGR

SEQ ID NO: 2998 - protein, 88 aa, Secale cereale
MASAASRKAPSLVVAASVGAVEALKDQAGLCRWGYPLRSLYRHAAAAPGVRALSASLSEATAAPRPAPLSAEDAKLRKAHHLVCWGPN

SEQ ID NO: 2999 - protein, 88 aa, Triticum aestivum
MASAASRKAPSLVVAATVGAVEALKDQAGLCRWGYPLRSLYRRAAAAPRVRALSASLSDAAAAPRPAPLSAEDAKLRKAHHLVCWGPN

SEQ ID NO: 3000 - protein, 84 aa, Lolium multiflorum
MASAASRKAPSLVVAASVGAVEALKDQAGLCRWGYPLRSLYRSAAAAPTVRAISASLREARPASSAAEDTKLRKTHHLVCWGPN

SEQ ID NO: 3001 - protein, 226 aa, Triticum aestivum
MDISQEQQQDFGVLLKQGAEGRVFVSTFVGRKCVIKERFSKKYRHPLLDSKLTLKRLNAEARCMTKARRLGVPTPVLYAVDPLPHTLTFEYVDGLCVKDILLGFGSNGINEERLNDIATQIGNAVGKLHDGGLVHGDLTTSNMMIKNSTNQLVLIDFGLSFTSTIPEDKAVDLYVLERALISMHSSCGDVMEKILAAYRKASRQWCATTNKLAQVRQRGRKRTMVG

SEQ ID NO: 3002 - protein, 226 aa, Secale cereale
MDISQEQQQDFGVLLKQGAEGRVFLSTFVGRKCVIKERFSKKYRHPLLDSKLTLKRLNAEARCMTKARRLGVPTPVLYAVDPLPHTLTFEYVDGLCVKDILLGFGSNGINEERLNDIATQIGNAVGKLHDGGLVHGDLTTSNMMIKNSTNQLVLIDFGLSFTSTIPEDKAVDLYVLERALISMHSSCGDVMEKILAAYRKASRQWCATTNKLAQVRQRGRKRSMVG

SEQ ID NO: 3003 - protein, 226 aa, Secale cereale
MDISQEQQQDFGVLLKQGAEGRVFLSTFVGRKCVIKERFSKKYRHPLLDSKLTLKRLNAEARCMTKARRLGVPTPVLYAVDPLPHTLTFEYVDGLCVKDIFLGFGSNGINEERLNDIATQIGNAVGKLHDGGLVHGDLTTSNMMIKNSTNQLVLIDFGLSFTSTIPEDKAVDLYVLERALISMHSSCGDVMEKILAAYRKASRQWCATTNKLAQVRQRGRKRSMVG

SEQ ID NO: 3004 - protein, 163 aa, Secale cereale
MTKARRLGVPTPVLYAVDPLPHTLTFEYVDGLCVKDILLGFGSNGINEERLNDIATQIGNAVGKLHDGGLVHGDLTTSNMMIKNSTNQLVLIDFGLSFTSTIPEDKAVDLYVLERALISMHSSCGDVMEKILAAYRKASRQWCATTNKLAQVRQRGRKRSMVG

SEQ ID NO: 3005 - protein, 225 aa, Brachypodium distachyon
MESSQEQQDFGVLLKQGAEGRVFVSTFVGRKCVTKERFSKKYRHPLLDSKLTLKRLNAEARCMTKARRLGVPTPVLYAVDPLLHTLTFEYVDGLCVKDVLLGFGSNGINEERLNDIATQIGNAIGKLHDGGLVHGDLTTSNMMIKNGTNQLVLIDFGLSFTSTIPEDKAVDLYVLERALISMHSSCGDVMEKILSAYRKASKQWCSTTNKLAQVRQRGRKRAMIG

SEQ ID NO: 3006 - protein, 226 aa, Oryza sativa
MDSTQEQQQDFGVLLKQGAEGRVFVSTFVGRKCVIKERFSKKYRHPLLDSKLTLKRLNAEARCMTKARKLGVPTPVLYAVDPLLHTLTFEYVDGLSVKDILLGFGSNGINEEQLIDIATQIGNAVGKLHDGGLVHGDLTTSNMIIKNNTNQLVLIDFGLSFISTIPEDKAVDLYVLERALISMHSSCGDVMEKILTAYRKASKQWCATTNKLAQVRQRGRKRTMIG

SEQ ID NO: 3007 - protein, 226 aa, Panicum virgatum
MDTSQEQEHDFGVLLKQGAEGRVFASTFVGRKCVIKERFSKKYRHPLLDAKLTLKRLNAEARCMTKARRLGVPTPVLYAVDPLLHTLTFEYVDGLSVKDILLGFGSNGVNVERLNDIATQIGHAIGKLHDGGLVHGDLTTSNMIIKSSNNQLVLIDFGLSFTSTIPEDKAVDLYVLERALISMHSSCGDVMEKILAAYRKASKQWCSTQNKLAQVRQRGRKRTMVG

SEQ ID NO: 3008 - protein, 226 aa, Sorghum bicolor
MDTSQEQEQDFGVLLKQGAEGRVFASTFVGRKCVIKERFSKKYRHPLLDSKLTLKRLNAEARCITKARKLGVPTPVLYAVDPLLHTLTFEYVDGLSVKDILLGFGSDGVNEERLNDIATQIGNAVGKLHDGGLVHGDLTTSNMIIKNSNYQLVLIDFGLSFTSTIPEDKAVDLYVLERALISMHSSCGDVMEKILAAYRKASKQWCSTQNKLAQVRQRGRKRTMVG

SEQ ID NO: 3009 - protein, 226 aa, Zea mays
MDMSQEQEQDFGVLLKQGAEGRVFASTFVGRKCVIKERFSKKYRHPLLDSKLTLKRLNAEARCMTKARRLGVPTPVLYAVDPVLHTLTFEHVDGLSVKDILLRFGSDGVNEERLNDIATQIGNAIGKLHDGGLVHGDLTTSNMIIKNSNNQLVLIDFGLSFTSTIPEDKAVDLYVLERALISMHSSCGDVMEKILAAYRKASKQWCSTQNKLAQVRQRGRKRTMVG

SEQ ID NO: 3010 - protein, 226 aa, Panicum virgatum
MDTSQEQEKDFGVLLKQGAEGRVFASTFVGRKCVIKERFSKKYRHPLLDAKLTLKRLNAEARCMTKARRLGVPTPVLYAVDPLLHTLTFEYVDGLSVKDILLGFGSNGVNVELLNDIATQIGHAIGKLHDGGLVHGDLTTSNMIIKSSNNQLVLIDFGLSFTSTIPEDKAVDLYVLERALISMHSSCGDVIEKILVAYRKASKQWCSTQNKLAQVRQRGRKRTMVG

SEQ ID NO: 3011 - protein, 670 aa, Setaria italica
MAMRRLTAAALTRRALPPCRRALCSGAPLGPELDAAVRDVVCSGSGSLDEVGSRLDRLGVAVSPALVGRVIDSCGESGGVGSGRRLLRFLAWCRSKDPGALGEGALDRAIGVLARAGDLTAMRIAIADVEKDGRRMAPETFTTVVEALVDAGNEDEAVRLFRGLERQKLLPERGDSVRGDGVWSSSLATVQALCKRGHAREAQGVVWHHKSELSVEPMVSIVERSLLHGWCVHGNAKEARRVLDEMKSAGVPLGLPSFNDFLHCVCHRNLKFNPSALVPEAMDILAEMRSYGVAPAASSFNILLSCLGRARRVKEAYRILYLMIEGKAGCSPDWVSYYLVGRVLYLTGRIIRGKRLVHAMLENGVLPTAKFFHGLIGVLCGTEQVDHALDMFRLMESCELVDTHIYDLLIEKLCRNGRFELGRELWDDATKSGLVLGCSEDLLDPLKTEDQEHDFGVLLKQGAEGRVFVSTFVGRKCVIKERFSKKYRHPLLDAKLTLKRLNAEARCMTKARRLGVPTPVLYAVDPLLHTLTFEYVDGLSVKDILLGFGSNGVNEERLNDIATQIGNAIGKLHDGGLVHGDLTTSNMIIKNSNNQLVLIDFGLSFTSTIPEDKAVDLYVLERALISMHSSCGDVMEKILAAYRKSSKQWCSTQNKLAQVRQRGRKRTMVG

SEQ ID NO: 3012 - protein, 226 aa, Saccharum officinarum
MDTSQEQEQDFGVLLKQGAEGRVFASTFVGRKCVIKERFSKKYRHPLLDSKLTLKRLNAEARCMTKARRLGVPTPVLYAVDPLLHTLTFEYVDGLSVKDILLGFGSDGVNEEHLNDIATQIGNAIGKLHDGGLVHGDLTTSNMIIKNSNNQLVLIDFGLSVTSTIPEDKAVDLYVLKRALISMHSYCGDVMEKNLAAYKKASKQWCSTQNKLAQVRQRGRKRAMVG

SEQ ID NO: 3013 - protein, 210 aa, Avena sativa
MDTSQEQQDFGVLLKQGAEGRVFVSTFVGQKCVIKERFSKKYRHPLLDSRLTLKRLNAEARCMTKARRLGVPTPVLYAVDPIPHTLTFEYVDGLCVKDILLGFGSDGINEERLNDIATQIGNAVGKLHDGGLVHGDLTTSNMMIKNNTNQLVLIDFGLSFTSAIPEDKAVDLYVLERALISMHSSCGDVMGKILSAYRKASRHGAPLRTS

SEQ ID NO: 3014 - protein, 226 aa, Amborella trichopoda
MDIDSKEEDGFRVLLKQGAEARVFESTFMGRRSIIKERFSKKYRHPTLDSKLTLKRLNAEARCMTKARRLGVATPALYAVDPLLHTLTFEYIEGPSVKDVLLDFGLTGVVEERINDIAGQIGNAIGKLHDGGLVHGDLTTSNMLLQSSTNNLVLIDFGLSFTSTLSEDKAVDLYVLERALISMHSSCGNVMDRILVAYRKSSKQWCATLNKLAQVRQRGRKRTMVG

SEQ ID NO: 3015 - protein, 219 aa, Ananas comosus
NKEFGVLLKQGAEARVFESIFVGQKCIIKERFSKKYRHPMLDSKLTTKRLNAEARCMTKARRLGVPTPVLYAVDPLLHTLTFEYVNGPSVKEILLDFGLNGLVHERLDDIATQMGNAIGKLHDGGLIHGDLTTSNMIVKSGTNQLVLIDFGLSFNSTLPEDKAVDLYVLERALLSMHSSCGNVMDKILSAYRKASMQWSSTMNKLAQVRQRGRKRTMVG

SEQ ID NO: 3016 - protein, 523 aa, Brachypodium distachyon
MAFAAYGVRGPLKLAVGHGPFALANNHLCRGWRPPSSYAVSRASSANISSNAVRHMVRHSHLVAPSSERRRSNTKASAVDGSIVAEERITVLVIGGGGREHALCYALNRSPSCESVLCAPGNVGIAQSGDATCVSDLDISCSDDVISFCHKRRVGMVVVGPEAPLVAGLANDLVKAGIPTFGPSSEAAALEGSKDFMKKLCDKYNIPTAKYRTFMDPVEAKQYVNDQGAPIVVKADGLAAGKGVVVAMTLDEAFEAIDCMLVQGSFGSAGSQVIIEEFLEGEEASFFALVDGENALQLESAQDHKRVGDGDVGPNTGGMGAYSPAPIVTEQLKRMVMESIIIPTVKGMAAEGCKFVGVLYAGLMIEKKSGLPKLIEYNVRFGDPECQVLMMRLESDLAQVLLSACKGELGQVSLTWSPEIAMVVVMASEGYPGSYKKGTIIKNISNAEQVSPAVKIFHAGTALDGDGNLVAVGGRVLGVTAKGKDIEEARERAYAAADVIDWPEGFFRHDIGWRALKHKQIAN

SEQ ID NO: 3017 - protein, 525 aa, Brachypodium distachyon
MDFAAYSIRGPLKLAVGHDPYALSNNHLCCGWRPPASCAVSRVSSSNIPSNVVRHVVRDSPHLIALNSERLRSSLKASVLDGSIVAEDKITVLVIGGGGREHALCYALNRLPSCVSVLCAPGNVGIAQSGDATCVSDLDISSSDAVISFCHKRAVGMVVVGPDAPLVACLANDLVKAGIPTFGPSSETAALEGSKDFMKKLCDKYNIPTAKYRTFMDPVEAKQYVKDQGAPIVIKADGLAAGKGVVVAMSLDEAFEAIDCMLVEGSFGSAGSQVIIEEYLEGEEASFFALVDGENALPLESAQDHKRVGDGDVGPNTGGMGADSPAPIVTEELKRMVMESIIIPTVKGMAAEGRRFVGVLYAGLMIEKKSGLPKLIEYNVRFGDPECQVLMMRLESYLAQVLLSACKGELGKVSITWSPEIAMVVVMASEGYPGSYKKGTVIKNMDNAEQVSPAVKIFHAGTALDGDGNLVAVGGRVLGVTAKSKDIEEARARAYDAADAIDWPEGFFRRDIGWRALKHEQMANC

SEQ ID NO: 3018 - protein, 525 aa, Sorghum bicolor
MACVAYSIRYPLMLAARHRADVLAKNSLCIGLKSSVSYSVAQQWSSNCSSVMMRHATSHRHLIVRASARWRSNSKASATEVGAASDERITVLVIGGGGREHALCYALNRSPSCSAVLCAPGNAGIAQSGDATCIADLDISSSADVISFCRERGVGMVVVGPEAPLVAGLVNDLVKVGIPTFGPSSEAAALEGSKDFMKKLCDKYNIPTAKYRTFMDAVEAKQYVKHEGAPIVVKADGLAAGKGVVVAMTLDEAFEAIDSMLVEGSFGSAGSRVIIEEFLEGEEASFFALVDGENALPLESAQDHKRVGDGDVGPNTGGMGAYSPAPIVTDELKRIVMESIIVPTVKGMAAEGCKFVGVLYAGLMIEKKSGLPKLIEYNVRFGDPECQVLMMRLESDLAQVLLSACRGGLSNVSLTWSPEMAMVVVMASQGYPGSYKKGTVIKNLDKAEQVSPFVKIFHAGTALDEDGNLVAVGGRVLGVTAKGKDIEEARARAYDAVDAVDWPEGFFRRDIGWRALRHKQVANCL

SEQ ID NO: 3019 - protein, 327 aa, Triticum aestivum
MASEDSAAPVVVDDCRGVLLVYSDGAVVRRDGPGFATPVRDDGTVEWKDAEFDAPRGLGLRLYRPRQRNQLLPVFFYYHGGGFCIGSRTWPNCQNYCLRLAAELGAVVVAPDYRLAPENRLPAAIDDGAAALLWLASQAGPAGDTWLTEAADFTRVFISGDSAGGTIAHHLAVRFGSAAGRSELGNVRVRGYVQLMPFFGGTERTRSEAECPDDAFLNRPLNDRYWRLSLPPGATVDHPASNPFGPDSPALEAVELAPTLVVVGGRDILRDRAVDYAARLRAMGKPVGVREFEGQQHGFFTIDPWSDASAELMRALKRFIHTDGRFD

SEQ ID NO: 3020 - protein, 327 aa, Secale cereale
MASKDSAAPVVVDDCRGVLLVYSDGAVVRRDVPGFATPVRDDGTVEWKDAEFDAPRGLGLRLYRPRQRNQLLPVFFYYHGGGFCIGSRTWPNCQNYCLRLATELGAVVVAPDYRLAPENRLPAAIDDGAAALLWLASQAGPAGDTWLTEAADFTRVFISGDSAGGTIAHHLAVRFGSAAGRSELGNVRVKGYVQLMPFFGGTERTRSEAECPDDAFLNRPLNDRYWRLSLPPGATVDHPASNPFGPDSPALEPVELAPTLVVVGGRDILRDRALDYAARLRAMGKPVGVREFEGQQHGFFTIDPWSAASAELMHALKRFIDTDGRFD

SEQ ID NO: 3021 - protein, 338 aa, Brachypodium distachyon
MASEDSVAAPAPAPVVVDECRGVLFVYSDGSVVRRAGPGFATPVRDDGSVEWKDAVFDAAHGLGLRLYKPRDRKNHDLLPVFFYFHGGGFCIGSRTWPNCQNYCLRLAAELDAVVVAPDYRLAPEHRLPAALDDAAAALLWLASHAAPGGGDPWLTEAADFGRIFVSGDSAGGTIAHHLAVRFGCPTARTSLGPGVRVKGYVQLMPFFGGTERTRSEAECPDDAFLNRPLNDRYWRLSLPDGATADHPASNPFAPGESREALEAAEMAPTLVVVGGRDILRDRAVDYAARLRAMGKPVEVREFEGQQHGFFTIDPWSDASAELMRALKRFVDTDGRFD

SEQ ID NO: 3022 - protein, 199 aa, Triticum aestivum
MAGGSGGAGGGTGGGDSLARRAWRQYLLQLQRHPLRTKMVTAGCLAGVSDSVAQKLSGYQKIEKRRLLLKMIFGFAYGGPFGHFLHKVLDYIFKGKKDTKTVAKKVLLEQITSSPWNNLLFLFYYGYVVEKRPFKEVKTRVKKQYLSVQLSAWMFWPVVGWINHQYVPLQFRVIVHSFVACCWGIFLNLRARAMSLKQS

SEQ ID NO: 3023 - protein, 195 aa, Secale cereale
MEGGSGGAGGGDSLARRAWRQYLLQLQRHPLRTKMITAGCLAGVSDSVAQKLSGYHKIEKRRLLLKMIFGFAYGGPFGHFLHKVLDYIFKGKKDTKTVAKKVLLEQITSSPWNNLLFLFYYGYVVEKRPFKEVKTRVKKQYPSVQLSAWMFWPVVGWINHQYVPLQFRVIVHSFVACCWGIFLNLRARAMSLKQS

SEQ ID NO: 3024 - protein, 195 aa, Secale cereale
MVGGSGGAGGGDSLARRAWRQYLLQLQRHPLRTKMVTAGCLAGVSDSVAQKLSGYHKIEKRRLLLKMIFGFAYGGPFGHFLHKVLDYIFKGKKDTKTVAKKVLLEQITSSPWNNLLFLFYYGYVVEKRPFKEVKTRVKKQYPSVQLSAWMFWPVVGWINHQYVPLQFRVIVHSFVACCWGIFLNLRARAMSLKQS

SEQ ID NO: 3025 - protein, 199 aa, Brachypodium distachyon
MAGGVAGGGGGGGRGDSLPQRAWRQYLLQLRLHPLRTKMITAGCLAGVSDSVAQKLSGYQKIEKRRLLLKMIFGFAYGGPFGHFLHKVLDYIFKGKKDTKTVAKKVLLEQITSSPWNNILFLFYYGYVVERRPFKEVKTRVRKQYPSVQLSAWMFWPIVGWINHQYVPLQFRVIVHSFVACCWGIFLNLRARAMSLKQS

SEQ ID NO: 3026 - protein, 193 aa, Avena sativa
MAGGGGGDGDSLPRRAWKQYLLQLQLHPLRTKMITAGCLAGVSDSVAQKLSGYQTIEKRRLLLKMMLGFAYGGPFGHFMHKLLDYIFKGKKDTKTVAKKVLLEQITSSPWNNLLFLFYYGYVVEKRPFKEVKTRVRKQYPSVQLSAWMFWPVVGWINHQYVPLQLRVIVHSFVACCWGIFLNLRARATSLKQS

SEQ ID NO: 3027 - protein, 202 aa, Pennisetum glaucum
MAAAGGPVRGGGKGGKGEGSLAYRAWRQYLLQLQQHPLRTKMITAGCLAGVSDSVAQKLSGYQKIEKRRLFLKMLFGFAYGGPFGHFLHKILDYIFKGKKDTKTIAKKVLLEQVTSSPWNNLLFLFYYGYVVERRPLKEVTIRVKKQYPSVQLSAWMFWPIVGWINHQYMPLQFRVIFHSFIACCWGIFLNLRARAMSLKQA

SEQ ID NO: 3028 - protein, 205 aa, Oryza sativa
MAAAAVAAGRGGVRGRGEGEEGSLARRAWRQYLRQLQLHPLRTKMITAGCLAGVSDSVAQKLSGYQRIEKRRLLLKMLFGFAYGGPFGHFLHKVLDYIFKGKKDTKTIAKKVLLEQITSSPWNNLLFLFYYGYVVERRPFKEVKTRVKKQYPSVQLSAWMFWPIVGWINHMYMPLQFRVIFHSFVACCWGIFLNLRARAMSLKQS

SEQ ID NO: 3029 - protein, 199 aa, Setaria italica
MAAAGGAGRGGGKGEGSLAYRAWRQYLLQLQQHPLRTKMVTAGCLAGVSDSVAQKLSGYQKIEKRRLFLKMLFGFAYGGPFGHFLHKILDYIFKGKKDTKTIAKKVLLEQVTSSPWNNLLFLFYYGYVVERRPLKDVTIRVKKQYPSVQLSAWMFWPIVSWINHQYMPLQFRVIFHSFVACCWGIFLNLRARAMSLKQA

SEQ ID NO: 3030 - protein, 204 aa, Panicum virgatum
MAAAGGAGRGGGKGGGGKGEGSLAYRAWRLYLLQLQQHPLRTKMITAGCLAGVSDSVAQKLSGHQKIEKRRLFLKMLFGFAHGGPFGHFLHKILDYIFQGKKDTKTIAKKVLLEQVTSSPWNNLLFLFYYGYVVERRPLKEVTIRVKKQYPSVQLSAWMFWPIVGWINHQYMPLQFRVIFHSFVACCWGIFLNLRARAMSLKQA

SEQ ID NO: 3031 - protein, 205 aa, Sorghum bicolor
MASVGGAGRGEGKRDGGKGEEGSLARRAWRQYLLQLQQHPLRTKMITAGCLAGVSDTVAQKLSGYQKIEKRRLLLKMLFGFAYGGPFGHFLHKILDYIFQGKKDTKTIAKKVLLEQVTSSPWNNILFLFYYGYVVERRPLKEVTTRVKKQYPSVQLSAWMFWPIVGWINHQYMPLQFRVIFHSVVACCWGIFLNLRARAMSLKQA

SEQ ID NO: 3032 - protein, 204 aa, Panicum virgatum
  misc_feature (36)..(36): Xaa can be any naturally occurring amino acid
MAAAGGAGRGGGKGGGGKGEGSLAYRAWRLYLLQLXQHPLRTKMITAGCLAGVSDSVAQKLSGHQKIEKRRLFLKMLFGFAHGGPFGHFLHKILDYIFQGKKDTKTIAKKVLLEQVTSSPWNNLLFLFYYGYVVERRPLKEVTIRVKKQYPSVQLSAWMFWPIVGWINHQYMPLQFRVIFHSFVACCWGIFLNLRARAMSLKQA

SEQ ID NO: 3033 - protein, 203 aa, Zea mays
MASVGRAGRGGKGDGGKGEGSLARRAWRQYLLQLQQHPLRTKMITAGCLAGVSDSVAQKLSGFQKIEKRRLLLKMLFGFAYGGPFGHFLHKILDYIFQGKKDTKTIAKKVLLEQVTSSPWNNILFLFYYGYVVERRPLKEVTTRVKKQYPSVQLSAWMFWPIVSWINHQYMPLQFRVIFHSFVACCWGIFLNLRARAMSLKQA

SEQ ID NO: 3034 - protein, 200 aa, Cynodon dactylon
MAAAGGGKAGGRKKGEESLPRVAWRNYMLQLQQHPLRTKMITAGCLAGVSDSVAQKLSGYQKIDKRRLLLKMLFGFAYGGPFGHFWHKVLDYIFRGKKDTKTIAKKVLVEQLTSSPWNNILFLFYYGYVVERRPFTEVKNRVKKQYPSVQLSAWMFWPIVGWINYQYMPPQFRVIFHSFVACCWGIFLNLRARAMSLKQA

SEQ ID NO: 3035 - protein, 860 aa, Secale cereale
MRPSRRDLAVLCCCCFLLLLLPLPSHGKDMPLGSTLSPGGNSAAWSSPNSTFSLAFAPSPTAPSLSVAAVTYAGGISVWSAGAGAPVDSGGSLRLSSTGDLQLVNGSGAVLWSSGTAGRGVSAAALQESGNLVLKNSTGGAVWQSFDHPTDTVVMSQNFASGMNLTSGPYVFAVDRATGNLTLRWATAGSATVTYFNKGYNSTFTANKTLSSPTLTMQTNGIVSLTDGTLNAPVVVAYSSNYGESGDMLRFVRLDSDGNFRAYSAGRGSGTATEQWSAVADQCEVFGYCGNMGVCGYNGTSPVCMCPSLNFELNDANNPRSGCKRKTELQNCPGNSTMLQLDNTQFLTYTPEITTEQFFVGITACRLNCLSGSSCVASTALSDGSGLCFLKVSNFVSAYQSASLPSTSFVKVCFPGQPNPPLSTGDQSNSRSSGLRGWVVALVVLGVVSGLVLAEWLLWWVFCRNSPKYGPASAQYALLEYASGAPVQFSYRELQRSTKGFKEKLGAGGFGAVYRGVLANRTVVAVKQLEGIEQGEKQFRMEVATISSTHHLNLVRLIGFCSEGRHRLLVYEFMKNGSLDSFLFGAGGGSSNDSGKAMSWATRFAVAVGTARGITYLHEECRDTIVHCDIKPENILLDEQHNAKVSDFGLAKLINPKDHRHRTLTSVRGTRGYLAPEWLANLPITVKSDVYSYGMVLLETVSGHRNFDISEETSRKKFSVWAYEEYEKGNVVAIVDRRLAGEEVDMAQVERALQVSFWCIQEQPSQRPSMGKVVQMLEGVMELERPPPPKSSDSFMTVTTATTGVSSSVASTFASSVAAPPAPVPSPNVEQEMSVGRSASARTREIASVPLRSSEPYMTM

SEQ ID NO: 3036 - protein, 862 aa, Brachypodium distachyon
MRTLWGGEDLAFLLRCCSLLLLLASFSHGADMPTGSSLSPGNQAAPWLSPNSTFSLAFAPSPSSPSLFVAAVTYAGGVPVWSAGAGAAVDSGGSLRLSSTGDLQLVNGSGAVLWSSGTGGRGVAAAALQESGNLVLKNSTGGALWQSFEHPTDTVVMSQSFTSSMNLTSGNYAFAVDRPSGNLTLRWSSSSSGSGGGNAVKYFNKGYNSTFTGNQTLTSPSLVMQSNGIVSLTDTSLSSPAVVAYSSNYGESGDMLRFVRLDADGNFRAYSAARGSSSATEQWSAVVDQCEVFGYCGNMGVCGYNGTSPFCSCPSQNFRPKDAADPRSGCERKVELVNCPGNSTMLELANTQFLTYPPEITTEQFFVGITACRLNCLSGGSCVASTALADGSGLCFLKVSPFVSAYQSASLPSTSFVKVCFPGVPNPPLVAGGGSSGGSSGLRAWVVALVVLGAVSGLVLCEWVLWWVFCRNSPKYGPASAQYALLEYASGAPVQFSYKELQRSTKGFKEKLGAGGFGAVYRGVLANRTVVAVKQLEGIEQGEKQFRMEVATISSTHHLNLVRLIGFCSEGRHRLLVYEFMKNGSLDAFLFAGADAPKMPWSTRFAVAVGTARGITYLHEECRDCIVHCDIKPENILLDEQHNAKVSDFGLAKLINPKDHRHRTLTSVRGTRGYLAPEWLANLPITVKSDVYSYGMVLLEIVSGHRNFDISEETDRKKFSVWAYEEYEKGNIACIVDKRLAEEDIDMAQAERALQVSFWCIQEQPVQRPTMGKVVQMLEGIMELERPPPPKSSDSFLTVTTATGSTSGASSSMASTFASSALVAPMSTPNLEQQMAVGRSASVRDREIASHPLRSSEPYMTM

SEQ ID NO: 3037 - protein, 854 aa, Setaria italica
MRPLRGKHGDLAILCCLALLLPLLSHGADMPLGSTLSPGNSAPWTSPNNTFSLSFTASPTSPSLFVAAITYAGGVPVWSAGAGAAVDSGGSLRLSSNGDLQLVNGSGAVLWSSNTGGRGVAAAAVQESGNLVLKNSTATLWQSFDHPTDTVVMSQNFTSGMNLTSGPYVFSVDKSSGNLTLKWTSGANTVTYFNKGYNTTFTGNKTLSSPTLTMQTNGIVSLTDGQLTAPVVVAYSSNYGESGDMMRFVRLDADGNFRAYSAARGSNAAAEQWSAVADQCQVFGYCGNMGVCSYNGTSPVCGCPSLNFQFSNPSNPRDGCKRKVDLQNCPGNSTMLQLDNTQFLTYPPEITTEQFFVGITACRLNCLSGGSCVASTALSDGSGLCFLKVSNFVSAYQSAALPSTSFVKVCFPGLPNPAPDAATSSSRGGSGVRAWVVAVVVLGAVSALVLCEWALWWWFCRHSPKYGPASAQYALLEYASGAPVQFSYRELQRSTKGFKEKLGAGGFGAVYRGVLANRTVVAVKQLEGIEQGEKQFRMEVATISSTHHLNLVRLIGFCSEGRHRLLVYEFMKNGSLDAFLFGAAPGGKMPWPTRFAAAVGTARGITYLHEECRDCIVHCDIKPENILLDEHFNAKVSDFGLAKLVNPKDHRHRTLTSVRGTRGYLAPEWLANLPITAKSDVYSYGMVLLEIVSGHRNFDVSEETGRKKFSVWAYEEYEKGKIFDIIDKKLPGEDIDMAQVERALQVSFWCIQEQPAQRPSMGKVVQMLEGIMDLERPPPPKSSDSFLSTTTGSTGIGSGVSTSIVSSTVASSAPIAPTTSPNLEQEMALARSTSATNRERVSRQLLSPQPYMTM

SEQ ID NO: 3038 - protein, 858 aa, Oryza sativa
MRRKAAGDAALVGGCFLLLLHPLLSHGADMPLGSSLSPANQALWSSPNNTFSLSFTASPTSPSLFVAAITYAGGVPVWTAGNGATVDSGGALRLSSSGDLQLVNGSGAVVWSSNTGGQGVTTAALQESGNLLLRNSSATLWQSFEHPTDTVVMGQNFTSGMNLTSASYQFSLDRNTGNLTLKWTGGGTVTYFNKGYNTTFTANKTLSSPTLAMQTNGIVSLTDGSLTSPVVVAYSSNYGESGDMLRFVRLDTDGNFRAYSAARGSNAPTEQWSAVADQCQVFGYCGNMGVCGYNGTSPVCRCPSENFQLSNPADPRGGCRRKIELQNCPGNSTMLQLDNTQFLTYPPEITTEQFFVGITACRLNCLSGSSCVASTALSDGSGLCFLKVSNFVSGYQSAALPSTSFVKVCFPGIPNPPLGGGGSPSGRASGVRGWVVAVVVLGAVSGLVLCEWALWWVFCRHSPKYGAASAQYALLEYASGAPVQFSYRELQRSTKGFKEKLGAGGFGAVYRGVLANRTVVAVKQLEGIEQGEKQFRMEVATISSTHHLNLVRLIGFCSEGRHRLLVYEFMKNGSLDAFLFADAPGGRMPWPTRFAVAVGTARGITYLHEECRDCIVHCDIKPENILLDEHHNAKVSDFGLAKLVNPKDHRHRTLTSVRGTRGYLAPEWLANLPITAKSDVYSYGMVLLELVSGHRNFDVSEETGRKKYSVWAYEEYEKGNIAAIVDKKLPGEDIDMVQVERALQVSFWCIQEQPAQRPSMGKVVQMLEGIMDLERPPPPKSSDSFLSLTSATTATGVSGSGSTSMVSTFTSSAAPPAPTPSPNVDEVQQEMAVGRSASARIRDRASRSLLGQEPYMTM

SEQ ID NO: 3039 - protein, 421 aa, Brachypodium distachyon
MGIPSDEVVQIRHPDVAGDPTVVTISCPDKTGLGCDLCRVVLLFGLNVLKGDMSTDGRWCYIVLWVVARRGRTMAWDLLKERLVELCPVSSLCGLDSSYLAAAGLQEDLEPAAPRVFLLKFSCYDRMGLLHDVTHVLSEMELTIRRVKVSTTPDGRVMDLFFITDARDLLHTKNRREEAYEKLQSVLGDSVTSCEIECATEDMSSCLQASALLPPLVVEQMFNTDLIEEQLSRSRSSSKLSVTMDNSLSPVHSLIQIQCGDHKGLLYDIMRTLKDCDIQISYSRFYAGRKDRCEVDLFAVQSDGKKILDQQKQRALCSRLRMELLHPLRVALVNRGPDMELLVANPVEISGKGRPLVLHDITLALKNLHRRIFLAEIGRHVVDDREWEVYRVHLGEDDHELSCAVRRKIVDGVTNMLMGWE

SEQ ID NO: 3040 - protein, 400 aa, Secale cereale
MQRAAASLASSRSAAAWACSTTSRHAGSGASCSAAARRYSVVPLRIRGQEQRPAALPMSLSLLSGSRPARTTAAAAATAELAPADEVGAGGSIAGTVQLGAMIVAWYLLNIYFNIYNKQVLQVLPLPLPYTITAFQLAFGSLVIFFMWAARLHPVPKLSAGQLAKIAPLAAGHMLGTVFTNMSLGMVAVSFTHTVKASEPFFTVLLSAFFLGEVPSPLVLGSLVPIVGGVALASLTEVSFNWVGFWSAMASNLLNQTRNVLSKRLLGGEEEEFMDDINLFSVITVLSFLLSFPLMIFTEGVRFSPAFLQSTGLNLQELCVRAALAGLCFHGYQKLSYMILARVSPVTHSVANCVKRVVVIVSSVLFFRTPISPVNALGTGAALAGVYLYSRLKKTKPKSS

SEQ ID NO: 3041 - protein, 342 aa, Triticum aestivum
SLSLLSGSRPARTAKAAAAAAELAPADEVAAGGGIAGTVQLGAMIVAWYLLNIYFNIYNKQVLQMLPLPLPYTITAFQLAFGSLVIFFMWAAKLHPVPKLSAAQLAKIAPLAAGHMLGTVFTNMSLGKVAVSFTHTVKASEPFFTVLLSAFFLGEVPSPLVLGSLVPIVGGVALASLTEVSFNWVGFWSAMASNLLNQTRNVLSKRLLGGEEEEFMDDINLFSVITVLSFLLSLPLMIFAEGVSFSPAFLQSTGLNLQELCVRAALAGLCFHGYQKLSYMILARVSPVTHSVANCVKRVVVIVSSVLFFRTPISPVNALGTGAALAGVYLYSRLKKAKPKSS

SEQ ID NO: 3042 - protein, 397 aa, Brachypodium distachyon
MQRAAASLSSSRAAAWAAAASSRHAAGASCSAAAGRRENTMAPPPLRILRGQQLLPLLPLLSGNRARRAVTASAAAAAELPAGDDAAAGGIAGAVELGAMIVAWYLLNIYFNIYNKLVLQALPFPYTMTAFQLGFGSLVIFFMWAARLHPAPKLSAAQLARIAPLAAGHMLGTVFTNMSLGKVAVSFTHTVKASEPFFTVLLSAFFLGETPSLLVLGSLVPIVGGVALASLTEVSFNWVGFWSAMASNLLNQTRNVLSKRLLGGQQEEESMDDINLFSVITVLSFLMSCPLMLLAEGVKFSPAYLQSTGLNLPELCVRAALAGLCFHGYQKISYMILARVSPVTHSVANCVKRVVVIVSSVLFFRTPISAVNALGTGAALGGVYLYSRLKKSKPKSI

SEQ ID NO: 3043 - protein, 358 aa, Secale cereale
MADEHHGAGAGFWLPDEFLDDDFFADEKAAAAAAARSDSDDEDGLGGLSRRVAGLDCDGGDRAIPKAEVMSGSPQSTLCVLQASGEDSPTGGASQVSSPPSSPLEQQPADPWDLLHEAAGQVARLGADSIPVPVVNPSPIHGAAVTPPARKPSSPLLPSPKPVGPYQYPPNNSFAQRQAQVARFHLLKQQQLMKHQREQQLAMAAAMAWGSTDVGPLGLSPSAWPPLQKSPHHAPPSAAGMRAVFLTPPGAKRECTGTGVFIPRQAGAPAEPKKKPSCSTVLLPARVVQALNLNVEDLGARPCYPGAFVLDHDALVSRSNAMQASQRREHNNANAGAAAHSPPLAVACEVNLPQEWTY

SEQ ID NO: 3044 - protein, 358 aa, Secale cereale
MADEHHGAGAGFWLPDEFLDDDFFADEKAAAAAAARSDSDDEDGLGGLSRRVAGLDCDGGDHAIPKAEVMSGSPQSTLCVLQASGEDSPTGGASQVSSPPSSPLEQQPADPWDLLHEAAGQVARLGVDTIPVPVVNPPPIHGAGVAPPARKPSPPLLPSPKPVGPYQYPPNNSFAQRQAQVARFHLLKQQQLMKHQREQQLAMAAAMAWGSTDVGPLGLSPSAWPPLQKSPHHAPPSAAGMRAVFLTPPGAKRECTGTGVFIPRQAGAPAEPKKKPSCSTVLLPARVVQALNLNVEDLGARPCYPGAFVLDHDALVSRSNAMQASQRREHSNANAGAAAHSPALAVACEVNLPQEWTY

SEQ ID NO: 3045 - protein, 309 aa, Triticum aestivum
MAVEWSDGGEEFLLPDEFLDDDFFSEEEKAAVAARSESDEEDSLAGLSRRLAGLLGGDKLAVTPAKEEVTAGSPKSTLCGLPKSGQESPNSGASHGNSPPSSPLEQQPADPWDLLHEAAGQVARLGVDSVPVPCQPSPHPRHRRRAAGEEALSAAASLPKARRPLPVPAEQLARPAPGPSRSFSSPEAAAADEAPEGAAAGHGGGHGVGLHRRRAARAEPLGLAAAAEVPAPRPTIRGRHARRFPHPSGGQARVHRHRRVHPPAGRRARRAQEETKLLHGSPPGARRAGAQPQRRGPRRPPVLPRSLRS

SEQ ID NO: 3046 - protein, 795 aa, Triticum aestivum
MDETPTSSGRSEATSCEPSWWPPDFLEKIESVALAREQEVLAEKESQFSLSNSRSSSWKASQLLWSTGTYSGFIPNGFYSIIPDKKLKESFPTIPSLTDLQSLEADGLKPEIIVVDAEKDKKIFMLKQLSGALVKGLNNPALVIKKIAGLVFDCFKGQSSDASPGRASTEDTHFFGNRGPQLLGQIRHGSCRPRAILFKVLADAVGLESKLVVGLPDDGAVGFVDSYKHMSVVVPLNSMELLVDLMRFPGQLIPFSAKAIFISHISAAGESDSAENDSCDSPLEPNSPLYGLSDKVEAEGIEASSNLSGRSLRNTMLRSRTFSEGKLSTSCSEPNIANAFWRRSQRRGVAEEPRGASSSPEHPLMRAKGRSILGDRQSFQEYTDRVTLRSDDQGVTTTPNPRRIRRRSISITPEIGDDIVRAVRAMNETLKQNRLQRDHVNDGSCSYIGADESNANDCPNNDDKSGTNNGLRNRAGSTQKAMSLPTSPHDYGGEISETSNNCDFISEEKMVFAWNRVLQSSPFNKPLSPFQEWNIDFSELTIGTRVGIGFFGEVFRGIWNGTDVAIKVFLEQDLTTENMEDFCNEIYILSRLRHPNVILFLGACMVPPHLSMVTEYMEMGSLYYLIHMSGHKKKLSWRRRLKIIRDICRGLMCIHRMKIVHRDLKSANCLVNKYWTVKICDFGLSRAITDSPMTDNSSAGTPEWMAPELIRNEPFSEKCDIFSLGVIMWELCTLSRPWDGIGPVKVVYAVTEGSLLEIPEGPLGKLIADCWAEPQDRPSCQEILARLLDCEYADS

SEQ ID NO: 3047 - protein, 796 aa, Triticum aestivum
MDETPTSSGRSEATSCEPSWWPPDFLEKIESVALAREQEVLAEKESRSSLSNSRSSSWKASQLLWSTGTYSGFIPNGFYSIIPDKKLKESFPTIPSLTDLQSLEADGLKPEIIVVDAEKDKKIFMLKQLSGALVKGLNNPALVIKKIAGLVFDCFKGQSSDASPGRASTEDTHFFGNRGPQLLGQIRHGSCRPRAILFKVLADAVGLESKLVVGLPDDGAVGFVDSYKHMSVVVPLNSMELLVDLMRFPGQLIPFSAKAIFISHISAAGESDSAENDSCDSPLEPNSPLYGLSDKVEAEGIEASSNLSGRSLRNTMLRSRTFSEGKLSTSCSEPNIANAFWRRSQRRGVAEEPRGASSSPEHPLMRAKGRSILGGDRQSFQEYTDRVTLRSDDQGVTTTPNPRRIRRRSISITPEIGDDIVRAVRAMNETLKQNRLQRDHVNDGSCSYIGADESNANDCPNNDDKSGTNNGLRNRAGSTQKAMSLPTSPHDYGGEISETSNNCDFISEEKMVFAWNRVLQSSPFNKPLSPFQEWNIDFSELTIGTRVGIGFFGEVFRGIWNGTDVAIKVFLEQDLTTENMEDFCNEIYILSRLRHPNVILFLGACMVPPHLSMVTEYMEMGSLYYLIHMSGHKKKLSWRRRLKIIRDICRGLMCIHRMKIVHRDLKSANCLVNKYWTVKICDFGLSRAITDSPMTDNSSAGTPEWMAPELIRNEPFSEKCDIFSLGVIMWELCTLSRPWDGIGPVKVVYAVTEGSLLEIPKGPLGKLIADCWAEPQDRPSCQEILARLLDCEYADS

SEQ ID NO: 3048 - protein, 750 aa, Triticum aestivum
RFNLSNSRSSSWKASQLLWSTGTYSGFIPNGFYSIIPDKKLKESFPTIPSLTDLQSLEADGLKPEIIVVDAEKDKKIFMLKQLSGALVKGLNNPALVIKKIAGLVFDCFKGQNSDASPGRASTEDTHFFGNRGPQLLGQIRHGSCRPRAILFKVLADAVGLESKLVVGLPDDGAVGFVDSYKHMSVVVPLNSMELLVDLMRFPGQLIPFSAKAIFISHISAAGESDSAENDSCDSPLEPNSPLYGLSDKVEAEGIEASSNLSGRSLRNTMLRSRTFSEGKLSTSCSEPNIANAFWRRSQRRGVAEEPRGASSSPEHPLMRAKGRSILGGDRQSFQEYTDRVTLRSDDQGVTTTPNPRRIRRRSISITPEIGDDIVRAVRAMNETLKQNRLQRDHVNDGSCSYIGADESNANDCPNNDDKSGTNNGLRNRAGSTQKAMSLPTSPHDYGGEISETSNNCDFISEEKMVFAWNRVLQSSPFNKPLSPFQEWNIDFSELTIGTRVGIGFFGEVFRGIWNGTDVAIKVFLEQDLTTENMEDFCNEIYILSRLRHPNVILFLGACMVPPHLSMVTEYMEMGSLYYLIHMSGQKKKLSWRRRLKIIRDICRGLMCIHRMKIVHRDLKSANCLVNKYWTVKICDFGLSRAITDSPMTDNSSAGTPEWMAPELIRNEPFSEKCDIFSLGVIMWELCTLSRPWDGIGPVKVVYAVTEGSRLEIPEGPLGKLIADCWAEPQDRPSCQEILARLLDCEYADS

SEQ ID NO: 3049 - protein, 802 aa, Brachypodium distachyon
MDEAPTSSGQSEATSCEPSWWPPDLLDKIESVAISRKQEVLVDKESRIILANSRSSSWKASQLLWSTGTYSGFIPNGFYSIIPDKKLKECFPTIPSLNELQTLEADGLRTDIIVVDAEKDKKIFMLKQLSAALVKGLNSSPALVIKKIAGLVFDCFKGQNPDVSPGRAATEDTHFFGNKGPQLLGQIRHGSCRPRAILFKVLADAVGLESKLVVGLPDDGADGFVDSYKHMSVVVPLNSMELLVDLMRFPGQLIPFSAKAIFTSHISAAGESDSAENDSCDSPLEPNSPLYGLSDKVEAEGIEASSNLSGRSLRNTMLRSRTFSEGKLSTSCSEPNIANAFWRRSQRKGVAEEPRCASSSPEHPLMRAKGRSILSGERQSFQEYTDGVTSRSDDPGGTTIPTPRRIRRRSISITPEIGDDIVRAVRAMNETLKQNRLQRDHVNDGSCSYISEDTSNAHDCPNKDDKSGRDVATNNGLRNRTCSTQKAMSLPTSPHDYEGGISETSDNCDFISKEKMVFAWNKVLQSSPFNKPLLPFQEWNIDFSELTIGTRVGIGFFGEVFRGIWNGTDVAIKVFLEQDLTTENMEDFCNEIYILSRLRHPNVILFLGACMVPPHLSMVTEYMEMGSLYYLIHMSGQKKKLSWRRRLKIIRDICRGLMCIHRMKIVHRDLKSANCLVNKHWTVKICDFGLSRAMTDSPMTDNSSAGTPEWMAPELIRNEPFSEKCDIFSLGVIMWELCTLSRPWDGISPVQVVYAVANEGSRLEIPEGPLGKLIADCWAEPQDRPSCQEILTRLLDCEYSTS

SEQ ID NO: 3050 - protein, 801 aa, Oryza sativa
MDDTPTSSGKSEVNSCEPSWWPPDFLAKIESVSLSRKQSVFSDKEPRSNLRSSSWKASQLLWSTGTYSGFIPNGFYSIIPDKKLKENFPTIPSLDDLQTLEADGLKADIIIVDVERDKKLFMLKQLSGALVKGLNSSPALVIKKIAGLVFDCFKSLDPDVSPARSPTEDNHFFGNKGSQLLGQIKHGSCRPRAILFKVLADAVGLESKLVVGLPDDGGVGFVDSYKHMSVVVSLNSMELLVDLMRFPGQLIPFSAKAIFISHISAAGESDSAENDSCDSPLEPNSPLYGLSDKVEAEGIEASSNLSGRSLRNVMLRSRTFSEGKLSTSCSEPNIANAFWRRSQRRGVAEEPRGASSSPEHPLMKTRARSILGGEQHSFQEYAESGVTSRSDGLGGASTSKTRRIRGRSISITPEIGDDIVRAVRAMNETLKQNRLQRDHVNEGSPSYVGEDQNNASDCPNNDDTSGGVVATNNGPRNRNGSTQKAMSLPSSPHEYRAQISETINPCDFVSKEKMVLAWNKVLQSSPFLNKPLLPFEEWNIDFSELTIGTRVGIGFFGEVFRGIWNGTDVAIKVFLEQDLTTENMEDFCNEIYILSRLRHPNVILFLGACMVPPHLSMVTEYMEMGSLYYLIHMSGQKKKLSWRRRLKIVRDICRGLMCIHRMKIVHRDLKSANCLVNKHWTVKICDFGLSRVMTDSPMTDNSSAGTPEWMAPELIRNEPFTEKCDIFSLGVIMWELCTLSRPWDGISPVQVVYTVANEGSRLEIPEGPLGKLIADCWAEPQDRPSCQEILTRLLDCEYAVS

SEQ ID NO: 3051 - protein, 792 aa, Setaria italica
MDETPTSSGQSEASSSEPSWWPPDFLEKIESASISRKQDVLGNLRTSSWKASQLLWSQGSYSGLIPNGFYSIIPDKKLKETFPNIPSLDDLQALEADGLKADIIIVDTERDKKVFMLKQLSAALVKGLNSSPALVIKKIAGLVFDCFKRQNVDSSPARGSTEDTHFFGNKGPQLLGQIRHGSCRPRAILFKVLADAVGLESKLVVGLPDDGAVGFVDSYKHMSVVVSLNSMELLVDLMRFPGQLIPFSAKAIFISHISAAGESDSAENDSCDSPLEPNSPLYGLSDKVEAEGIESSSNLSGRSLRNMMLRSRTFSEGKLSTSCSEPNIANAFWRRSQRKGVAEESRGASSSPEHPLMRARGRSILGGEKQPFQEYTESGSASRSDGLSGTSTSNARRIRRRSISITPEIGDDIVRAVRAMNETLKQNRLQRDHVEGSCSYVTEDQNNANDCPNDDDASRRVGATDNGSRNRTGSTQKAMSLPSSPHEYRGQVTEKNDDFMSKEKMALAWNKVFQSSPFLNKPLLPFEEWNIDFSEITIGTRVGIGFFGEVFRGIWNGTDVAIKVFLEQDLTTENMEDFCNEIYILSRLRHPNVILFLGACITPPHLSMVTEYMEMGSLYYLIHMSGQKKKLSWRRRLKIIRDICRGLMCIHRMKIVHRDLKSANCLVNKHWTVKICDFGLSRVMIDSPMTDNSSAGTPEWMAPELIRNEPFTEKCDIFSLGVIMWELCTLSRPWEGISPVQVVYAVANEGSRLEIPEGPLGRLIADCWAEPDNRPSCQEILTRLLDCEYAVS

SEQ ID NO: 3052 - protein, 792 aa, Sorghum bicolor
MDETPTSSGQSEASSCEPNWWPADLLEKIESASISRKQDVLGNLRSSSWKASQLLWSTGSYSGLIPNGFYSIIPDKKLKETFPTVPSLDDLQTLEADGLKADVIIVDTERDKKIFMLKQLSAALVKGLSSSPALVIKKIAGLVFDCFKRQNPDASPARGSIEDTHFFGNKGPQLLGQIRHGSCRPRAILFKVLADAVGLESKLVVGLPDDGAVGFVDSYKHMSVVVSLNSMELLVDLMRFPGQLIPFSAKAIFISHISAAGESDSAENDSCDSPLEPNSPLYGLSDKVEAEGIESSSNLSGRSLRNMMLRSRTFSEGKLSTSCSEPNIANAFWRRSQRRGVAEEPRGASSSPEHPLMRARGRSILGGEKQSFQEYTESGAASRSDGLEGTSTSNARRIRRRSISITPEIGDDIVRAVRAMNETLKQNRLQRDHVEGSCSYVTEDQSNANDCPNNDDASRRIGATDSDSRNRTGSTQKAMSLPSSPHEYRGQVTQKSDDFISKEKMALAWNKVFQSSPFLNKPLLPFEEWNIDFSEITIGTRVGIGFFGEVFRGIWNGTDVAIKVFLEQDLTTENMEDFCNEIYILSRLRHPNVILFLGACITPPHLSMVTEYMEMGSLYYLIHMSGQKKKLSWRRRLKIIRDICRGLMCIHRMKIVHRDLKSANCLVNKHWTVKICDFGLSRVMIDSPMTDNSSAGTPEWMAPELIRNEPFTEKCDIFSLGVIMWELCTLSRPWEGISPVQVVYAVANEGSRLEIPEGPLGRLIADCWAEPENRPSCQEILTRLLDCEYTVS

SEQ ID NO: 3053 - protein, 792 aa, Zea mays
MDETPTSSGQSEDSSCEPNWWPPDLLEKIESASISRKHDVLGNLRSSSWKASQLLWSTGSYSGLIPNGFYSIIPDKKLKETFPTIPSVDDLQTLEADGLKADIIIVDTERDKKVFMLKQLSAALVKGLSSSPALVIKKIAGLVFDCFKRQNPDASPAKGSIEDTHFFGYKGPQLLGQIRHGSCRPRAILFKVLADAVGLESKLVVGLPDDGAVGFVDSYKHMSVVVSLNSMELLVDLMRFPGQLIPFSAKAIFISHISAAGESDSAENDSCDSPLEPNSPLYGLSDKVETEGIESSSNLSGRSLRNMMLRSRTFSEGKLSTSCSEPNIANAFWRHSQRRGVAEEPRGASSSPEHPLMRARGRSILGGEKQSFQEYTESGAASRSDGLGGTSTSNARRIRRRSISITPEIGDDIVRAVRAMNETLKQNRLQRDHVEGSCSYVTEDQSNANDCPNKDDASRIIGATDSDSRNRTGPTQKAMSLPSSPHEYRGQDTQKGDDFISKEKMALAWNKVFQSSPFLNKPLLPFEEWNIDFSEITIGTRVGIGFFGEVFRGIWNGTDVAIKVFLEQDLTTENMEDFCNEIYILSRLRHPNVILFLGACITPPHLSMVTEYMEMGSLYYLIHMSGQKKKLSWRRRLKIIRDICRGLMCIHRMKIVHRDLKSANCLVNKHWTVKICDFGLSRVMIDSPMTDNSSAGTPEWMAPELIRNEPFTEKCDIFSLGVIMWELCTLSRPWEGISPVQVVYAVANEGSRLEIPEGPLGRLIADCWAEPENRPSCQEILTRLLDCEYTVS

SEQ ID NO: 3054 - protein, 558 aa, Zea mays
MDETPTSSGQSEASSCEPNWWPPDFLEKIQSASIPRKHDVLGNQSSSSWKASQLLWSTGSYSGLIPNGFYSIIPDKKLKETFPTIPSLDDLQTLEADGLKADIIIVDTERDKKVFMLKQLSAALVKGLSSSPALVIKKIAGLVFDCFKRQIPDASPTRGSIEDTHFFGNKGPQLLGQIRHGSCRPRAILFKVLADAVGLESKLVVGLPDDGAVGFVDSYKHMSVVVSLNSMVLLVDLMRFPGQLIPFSAKAIFISHISAAGESDSAENDSCDSPLEPNSPLYGLSDKVEVEGIESSSYLSGRSLRNMMLRSRTFSEGKLSTSCSEPNIANAFWRRSQRRVAEEPRGASSSPEHPLMRARGRSILGSEKQSFQEYTESGAASRSDGLGGPSTSNARRIRRRSISITPEIGDDIVRAVRAMNETLKQNRLQRDHVEGSCSYVMEDQSNTNDCPNKDDASWRIGATDSDSRNRTGSTQKAMSLPSSPHEYRGQVTQKSDDFISKEKMALAWNKVFQSSPFLNKALLPFKEWNIDFSEITIGTRVGIGKILWRSFPWYMEWN

SEQ ID NO: 3055 - protein, 324 aa, Pseudoroegneria spicata
MGEDGQIRRDRVIIDTDPGIDDSMTILMAFGEPSVEIIGLTTIFGNVTTEYATRNALLLCERAGHPEVPVAEGSPEPLKGGEPRVADFVHGSDGLGNLSLPAPTTKKVEESAAEFMVNKVSQFPGEISVLALGPLTNVALAIKRDSSFASKVKKIVVLGGAFFAAGNVNPAAEANIYGDPDAADVVFTSGADIDVVGINITTQCCFTDEDLLELKNSKGLHAQFLCDMCKFYRDWHAKSDGFHGIFLHDPVSFTALVHPEYFTFKKGVVRVETQGICTGHTLMDHGLKKWNSENPWSGYAPISVAWTVDVPKVLAYVKKLLMAP

SEQ ID NO: 3056 - protein, 324 aa, Secale cereale
MGEDGQIRRDRLIIDTDPGIDDSMTILMAFGEPSVEIIGLTTIFGNVTTEYATRNALLLCERAGHPEVPVAEGSLEPLKGGEPRVADFVHGSDGLGNLSLPAPTTKKVEESAAEFMVNKVSQFPGEISVLALGPLTNVALAIKRDSSFASKVKKIVVLGGAFFAAGNVNPAAEANIYGDPDAADVVFTSGADIDVVGINITTQCCFTDEDLLELKNSKGVHAQFLCDMCKFYRDWHAKSDGFHGIFLHDPVSFTALVHPEYFTFKKGVVRVETQGICTGHTLMDHGLKKWNSENPWSGYAPISVAWTVDVPKVLAYVKKLLMAP

SEQ ID NO: 3057 - protein, 324 aa, Triticum aestivum
MGEDGQIRRDRVIIDTDPGIDDSMTILMAFGEPSVEIIGLTTIFGNVTTEYATRNALLLCERAGHPEVPVAEGSPEPLKGGEPRVADFVHGSDGLGNLSLPAPTTKKVEESAAEFMVNKVSQFPGEISVLALGPLTNVALAIKRDPSFASKVKKIVVLGGAFFAAGNVNPAAEANIYGDPDAADVVFTSGADIDVVGINITTQCCFTDEDLLELKNSKGVHAQFLCDMCKFYRDWHEKSDGFQGIFLHDPVSFTALVHPEYFTFKKGVVRVETQGICTGHTLMDHGLKKWNSENPWSGYAPISVAWTVDVPKVLAYVKKLLMAP

SEQ ID NO: 3058 - protein, 324 aa, Triticum aestivum
MGEDGQIRRDRVIIDTDPGIDDSMTILMAFGEPSVEIIGLTTIFGNVTTEYATRNALLLCERAGHPEVPVAEGSPEPLKGGEPRVADFVHGSDGLGNLSLPAPTTKKVEESAAEFMVNKVSQFPGEISVLALGPLTNVALAIKRDSSFASKVKKIVVLGGAFFAAGNVNPAAEANIYGDPDAADVVFTSGADIDVVGINITTQCCFTDEDLLELKNSKGVHTQFLCDMCKFYRDWHEKSDGFQGIFLHDPVSFTALVHPEYFTFKKGVVRVETQGICTGHTLMDHGLKKWNSENPWSGYAPISVAWTVDVPKVLAYVKKLLMAP

SEQ ID NO: 3059 - protein, 154 aa, Triticum aestivum
MGEDGQIRRDRVIIDTDPGIDDSMTILMAFGEPSVEIIGLTTIFGNVATEYATRNALLLCERAGHPEVPVAEGSPEPLKGGEPRVADFVHGSDGLGNLSLPAPTTKKVEESAAEFMVNKVSQFPGEISVLALGPLTNVALAIKRDSSFACKVKK

SEQ ID NO: 3060 - protein, 251 aa, Avena sativa
MGQDGQIRRDRIIIDTDPGIDDSMTILMAFEEPSVEIIGLTTIFGNVTTEYATRNALLLCERAGHPEVPVAEGSPEPLKGGIPRVADFVHGSDGLGNLFLPAPTTKKVEESAAEFLVNKVSQFPGEISVLALGPLTNVALAIKKDSSFASKVKKIVVLGGAFFAAGNVNPAAEANIYGDPDAADVVFTSGADIDVVGINITTQVCFKDEDLLELKNYKREGMHNSCVTCASSTEIGIPSLTASTGFSSMIL

SEQ ID NO: 3061 - protein, 327 aa, Brachypodium distachyon
MGQEGDGQIRRRDRVIVDTDPGIDDSMTILMAFEEPSVEIIGLTTIFGNVTTENATRNALLLCERAGHPEVPVAEGSPEPLKGGIPRVADFVHGSDGLGNLSLPAPTTKKVEENAAEFMVNKVSEFPGEITVLALGPLTNVALAIKRDPSFASKVKRIVVLGGAFFAAGNVNPAAEANIYGDPDAADVVFTSGADIDVVGINITTQVCLTDEDLLELKNSKGKHAQFLCDMCKFYRDWHYKSDGFQGIFLHDPVSFTALVHPEYFGFKKGVVRVETQGICTGHTLMDHGLKKWNTENPWSGYTPISVGWTVDVPKVLAYVKKLLVTP

SEQ ID NO: 3062 - protein, 324 aa, Oryza sativa
MGSNEQIHRDKLIIDTDPGIDDSMTILMAFRAPTVEIIGLTTIFGNTTTKNATQNALLLCERAGHPEVPVAEGSAEPLKGGEPRVADFVHGSDGLGNLFLPAPTSKKVDENAAEFMVNKVSQFPGEVSILALGPLTNVALAIKRDPSFASKVKKIVVLGGAFFAAGNVSPAAEANIYGDPEAADIVFTSGADVDVVGINITTQVCFTDEDLLELRNSKGKHAQFLCDMCQFYRDWHAESDGFHGIFLHDPVSFTALVHPEYFTFKKGVVRVETQGICTGHTLMDQGLKKWNSENPWSGYKPISVAWTVDVPNVLAFVKELLMAP

SEQ ID NO: 3063 - protein, 325 aa, Setaria italica
MGQDGHQIRGNKLIIDTDPGIDDSMTILMAFRTPSVEIIGLTTIFGNVSTEGATRNALLLCERAGHPEVPVAEGSPEPLKGGKPRIADFVHGSDGIGNMFLPEPTSKKVEESAAEFLVNKVSEFPGEVSVLALGPLTNVALAIKRDPSFASKVKKIVVLGGAFFAAGNVNPAAEANIHGDPEAADIVFTSGADIVVVGINITTQVCLKDEDLLELRNSKGKHAQFLSEMCKFYRDWHAKSDGFHGIFLHDPVSFTALVHPEYFTFKKGVVRVETQGICTGHTLMDQGLKKWNSENPWSGYKPISVAWMVDVPKVISFIKKLLMAP

SEQ ID NO: 3064 - protein, 325 aa, Panicum virgatum
MGQDGHQIRRHKLIIDTDPGIDDSMAILMAFREPSVEIIGLTTIFGNVSTEGATRNALLLCERAGHSEVPVAEGSPEPLKGGKPRIADFVHGSDGIGNLFVPEPTTRKVEESAAEFLVNKVSEFPGEVSVLALGPLTNVALAVKRDPSFASKVKKIVVLGGAFFAAGNVNPAAEANIHGDPEAADIVFTSGADIVVVGINITTQVCFTDEDLLELRNSKAKHAQFLSDMCKFYRDWHAKSDGFHGIFLHDPVSFTALVHPEYFTFKKGVVRVETQGICTGHTLMDQGLKKWNSENPWSGYKPISVAWTVDVPKVISFIKKLLMAP

SEQ ID NO: 3065 - protein, 325 aa, Panicum virgatum
MGQDGHQIRRHKLIIDTDPGIDDSMAILMAFREPSVEIIGLTTIFGNVSTEGATRNALLLCERAGHSEVPVAEGSPEPLKGGKPRIADFVHGSDGIGDLFLPEPTTKKVEESAAEFLVNKVSEFPGEVSVLALGPLTNVALAVKRDPSFASKVKKIVVLGGAFFAAGNVNPAAEANIHGDPEAADIVFTSGADIVVVGINITTQACFTDEDLLELRNSKGKHAQFLSDMCKFYRDWHAKSDGFHGIFLHDPVSFMALVRPEYFTFKKGVVRVETQGICTGHTLMDQGLKKWNSENPWSGYKPISVAWTVDVPKVISFIKKLLMAP

SEQ ID NO: 3066 - protein, 325 aa, Pennisetum glaucum
MGLDGHQIRAHKLIIDTDPGIDDSMTILMAFRTPSVEIIGLTTIFGNVSTEGATRNALLLCERAGHPEVPVAEGSPEPLKGGKPRIADFVHGSDGVGNMCLPEPTTKKVEESAAEFLVNKVSEFPGEVSVLALGPLTNVALAIKRDPSFASKVKKIVVLGGAFFAAGNVNPAAEANIHGDPEAADIVFTSGADIVVVGINITTQVCLKDEDLLELRNSKGKHAQFLSEMCKFYRDWHAKSDGFHGIFLHDPVSFTALVHPEYFTFKKGVVRVETQGICTGHTLMDQGLKKWNSENPWSGYKPISVAWTVDVPKVISFIKKLLMAP

SEQ ID NO: 3067 - protein, 325 aa, Zea mays
MGQDGQQIRRDKLIIDTDPGIDDSMTILMAFRAPSVEIIGLTTIFGNVDTKGATRNALLLCERAGCPEVPVAEGSHEPLKGGKPRVADFVHGSDGIGNLFLPAPSAKKVEESAADFLINKVSEFPGEVSVLALGPLTNVALAIKRDPSFASKVKKIVVLGGAFFAAGNVNPAAEANIHGDPEAADIVFTSGADIVVVGINITTQVCLTDEDLLELRNSKGKHAAFLYEMCKFYRDWHAKSDGFHGIFLHDPVSFTAVLHPEYFTFKKGVVRVETQGICTGHTLMDQGLKKWNSENPWSGYKPISVAWTVDVPKVISFIKKLLMAP

SEQ ID NO: 3068 - protein, 325 aa, Sorghum bicolor
MGQDGQQIRRDKLIIDTDPGIDDSMTILMAFRAPSLEIIGLTTIFGNVDTVGATRNALLLCERAGHPEVPVAEGSHEPLKGGKPRVADFVHGSDGIGNLFLPAPSAKKVEESAADFLINKVSEFPGEVSVLALGPLTNVALAIKRDPSFASKVKKIVVLGGAFFAAGNVNPAAEANIHGDPEAADIVFTSGADIVVVGINITTQVCLTDEDLLELRNSKGKHAPLLSEMCKFYRDWHAKSDGFHGIFLHDPVSFTAVLHPEYFTFKKGVVRVETQGICTGHTLMDHGLKKWNSENPWSGYKPISVAWTVDVPKVISFVKKLLMAQ

SEQ ID NO: 3069 - protein, 325 aa, Saccharum officinarum
MGQDGQQIRRDKLIIDTDPGIDDSMTILMAFGAPSLEIIGLTTIFGNVDTEGATRNALLLCERAGHPEVPVAEGSHEPLKGGKPRIADFVHGSDGIGNLFLPAPSAKKVEESAADFLVNKVSEFPGEVSVLALGPLTNVALAIKRDPSFASKVKKIVVLGGAFFAAGNVNPAAEANIHGDPEAADIVFTSGADIVVVGINITTQVCLTDEDLLELRNSKGNHAPLLSEMCKFYRDWHVKSDGFHGIFLHDPVSFTAVLHPEYFTFKKGVVRVETQGICTGHTLMDQGLKKWNSENPWSGYKPISVAWTVDVPKVISFVKKLLMEP

SEQ ID NO: 3070 - protein, 325 aa, Zea mays
MERDGQQTRRDKLIIDTDPGIDDSMAILMAFRAHTLEIIGLTTIFGNVDTEGATCNALLLCERAGHPEVPVAEGSHEPLKGGKPRIADFVHGSDGIGNLFLPAPSAKKVEESAADFMVNKVSEFPGEVSVLALGPLTNVALAIKRDPSFASKVNKIVVLGGAFFVAGNVNPAAEANILGDPEAADIVFTSGADVIVVGINITTQVCLTDEGLLELRNSKGKHAPFLSETCKFYRDWHVKSDGFHGIFLHDPVSFTAVLHPEYFTFKKGVVRVETQGICTGHTLMDQGLKKWNSENPWSGYKPISVAWTVDVPKVIGFVKKLLMAP

SEQ ID NO: 3071 - protein, 301 aa, Panicum virgatum
MAILMAFREPSVEIIGLTTIFGNVSTEGATRNALLLCERAGHSEVPVAEGSPEPLKGGKPRIADFVHGSDGIGNLFVPEPTTRKVEESAAEFLVNKVSEFPGEVSVLALGPLTNVALAVKRDPSFASKVKKIVVLGGAFFAAGNVNPAAEANIHGDPEAADIVFTSGADIVVVGINITTQVCFTDEDLLELRNSKGKHAQFLSDMCKFYRDWHAKSDGFHGIFLHDPVSFMALVHPEYFTFKKGVVRVETQGICTGHTLMDQGLKKWNSENPWSGYKPISVAWTVDVPKVISFIKKLLMAP

SEQ ID NO: 3072 - protein, 380 aa, Secale cereale
MLRAVARCCGHWPPGAAAADGMLWQTELRPHAAGEFSMAAAQANLIMEDQAQVLASPSATLVGVYDGHGGPDASRFLRSALFPHVQRFAKEQGGVTAEAIRRAFGAAEEDFLHEVRQAWPKRPRMAAVGSCCLLGAIAGDTLYVANLGDSRAVLGRRVVGGGVAVAERLSTDHNVASEEVRMEVSSQNPDDGQIVVHTRGAWRIKGIIQVSRSIGDVYLKKPEYSLDPLFRQIGPVIALKRPALSAEPQIHVRKLKPTDQFIIFASDGLWEHLSDDDAVQIVFKNPRTGIANRLVRSALKEATKKREVSVHDLRTIERGVRRHFHDDISVVVVYLDRHRGRRQTRVVDSSSNCTSAPVDIYSSSSSVQSAQPRQAYRDSG

SEQ ID NO: 3073 - protein, 93 aa, Secale cereale
MLRAVARCCGHWPPGAAAADGMLWQTELRPHAAGEFSMAAAQANLIMEDQAQVLASPPPRSSASTTATAAPSLPLPPLRLFPTSNASPRSRAA

SEQ ID NO: 3074 - protein, 372 aa, Triticum aestivum
MLRAVARCCGHWPPGAAAADGMLWQTELRPHAAGEFSMAAAQANLVMEDQAQVLASPSATLVGVYDGHGGPDASRFLRSALFPHVQRFAREQGGVTAEAIRRAFGAAEEDFLHEVRQAWPKRPRMAAVGSCCLLGAIAGDTLYVANLGDSRAVLGRRVVGGGVAVAERLSTDHNVASEEVRMEVSSHNPDDAQIVVHTRGAWRIKGIIQVSRSIGDVYLKKPEYSLDPLFRQIGPVIALKRPALSAEPQIHVRKLKPNDQFIIFASDGLWEHLSDDAAVQIVFKNPRTGIANRLVRAALKEATKKREVSVHDLRTIERGVRRHFHDDISVVVVYLDRHRGRRQTRVVDSSSNCTSAPVDIYSSSSSAYRDSG

SEQ ID NO: 3075 - protein, 379 aa, Brachypodium distachyon
MLRAVARCCGHWPPGAAAADGMLWQTELRPHAAGEFSMAAAQANLIMEDQAQVLASPAATLVGVYDGHGGPDASRFLRSSLFPHVQRFAKEQGGMSTEVIRRAFGAAEDEFLQQVRQAWPKRPRMAAVGSCCLLGAISGDTLFVANLGDSRAVLGRRVVGGTVAVAERLSTDHNVASEEVRMEVTSQNPDDGQIVVHTRGAWRVKGIIQVSRSIGDVYLKKQEYSMDPLFRQIGPVIALKRPALSAEPQIQVRKLKPTDLFLIFASDGLWEHLSDDDAVQIVFKNPRTGIANRLVRAALKEATKKREVSLHDLKTIEKGVRRHFHDDISVVVVYLDRHRGRRHTRVVDSSSNCTSAPVDIYSSNSGKSAQSLQAYRDSG

SEQ ID NO: 3076 - protein, 377 aa, Setaria italica
MLRALTRCCGHWPPGAAAADGMLWQTELRPHAAGEFSMAAAQANVAMEDQAQVLASPSATLVGVYDGHGGVDASRFLRSRLFPHVQRFATEQGGMSTEVIRRAFGAAEEEFHKQVRQEWTKRPRMAAVGSCCLLGAISGDTLYVANLGDSRAVLGRRVVGGGVAVAERLSDEHNAASEEVRRELAALNPDDAQIVVHARGAWRVKGIIQVSRSIGDFYLKKPEYSLDPLFRQVGPPVALKRPALSAEPSIQVRKLKPNDLFLIFASDGLWEHLSDDAAVQIVFKNPRTGIANRLVKAALKEATRKREVRYRDLRTIERGVRRHFHDDISVVVVYLDRHRERRHTRVIDSSSNCTSAPVDIYSSNTHQSAEPLQSYKS

SEQ ID NO: 3077 - protein, 380 aa, Oryza sativa
MLRAVARCCGHWPPGAAAADGMLWQTELRPHAAGEFSMAAAQANLAMEDQAQVLASPAATLVGVYDGHGGADASRFLRSRLFPHVQRFEKEQGGMSTEVIRRAFGAAEEEFLQQVRQAWRQRPKMAAVGSCCLLGAISGDTLYVANLGDSRAVLGRRVVGGGVAVAERLTDEHNAASEEVRRELTALNPDDAQIVVHARGAWRVKGIIQVSRTIGDVYLKKQEYSMDPVFRNVGPPIPLKRPALSAEPSIQVRKLKPNDLFLIFASDGLWEHLSDDAAVQIVFKNPRTGIANRLVKAALKEATRKREVSFRDLKTIEKGVRRHFHDDISVIVVYLDRHRGRRHTRVVDSSSNCTNAPVDIYSSNSGQSVETLQAHRGSGW

SEQ ID NO: 3078 - protein, 377 aa, Sorghum bicolor
MLRAVARCCGHWPPGAAAADGMLWQTELRPHAAGEFSMAAAQANVTMEDQAQVLASPAATLVGVYDGHGGADASRFLRSRLFPHVQRFAREQGGMSAEAIRSAFGAAEEEFHKQVRQEWTKRPRLAAVGSCCLLGAISGDTLYVANAGDSRAVLGRRVVGGGVAVAERLSTEHNAASEEVRRELTALNPDDAQIVVHARGAWRVKGIIQVSRSIGDFYLKKPEYSLDPLFRQVGAPIPLKRPALSAEPSVQVRKLKPNDLFLIFASDGLWEHLSDDDAVQIVFKNPRTGIANRLVKAALKEATRKREVRYRDLRTIDRGVRRHFHDDISVVVVYLDSHRERRHTRVIDSSSNCTSAPVDIYSSNTHQSAEPLHAYKC

SEQ ID NO: 3079 - protein, 377 aa, Pennisetum glaucum
MLRALTRCCGHWPPGAAAADGMLWQTELRPHAAGEFSMAAAQANAAMEDQAQVLASPSATLVGVYDGHGGADASRFLRSQLFPHVQRFATEQGGMSTDVIRRAFGAAEEEFHKQVRQEWTKRPRMAAVGSCCLLGAISGDTLYVANLGDSRAVLGRRVVGGGVAVAERLSDEHNAASEEVRRELAALNPDDAQIVVHVRGAWRVKGIIQVSRSIGDFYLKKPEYSLDPSFRQVGPPVALKRPALSAEPSIQVRKLKPNDLFLIFASDGLWEHLSDDAAVQIVFKNPRTGIANKLVKAALKEASRKREVRYRDLRTIERGVRRHFHDDISVVVVYLDRHRERRHTRVIDSSSNCTSAPIDIYSSNTHQSTGPLQSRKS

SEQ ID NO: 3080 - protein, 370 aa, Panicum virgatum
MLRAVARCCGHWPPSAAAADGMLWQTELRPHAAGEFSMAAAQANLAMEDQAQVLASPSDTLVGVYDGHGGADASRFLRSRLFPHVQRFATEQGGMSTEVIRRAFNETEEEFHTQVRQEWKQRPRMAAVGSCCLLGAISGDTLYVANLGDSRAVLGRRVVGGGVAVAERLSSEHNTASEEVRRELADLNPDDAQIVVHTRGAWRVKGIIQVTRSIGDFYLKKPEYSLDPLFRQVGPPIALKRPALSAEPSIQVRKLNPNDLFLIFASDGLWEHLSDDAAVQIVFKNPRTGIANRLVKAALKEATRKREVRYRDLRTIERGVRRHFHDDISVVVVYLDRHRERRHTRVIDSSSNCTSAPVDIYSSNTQSYKS

SEQ ID NO: 3081 - protein, 376 aa, Zea mays
MLRAVARCCGHWPPGAAAADGMLWQTELRPHAAGEFSMAAAQANLTMEDQAQVLASPSATLVGVYDGHGGVDASRFLRSGLFPHVQRFAREQGGISAEAIRSAFGAAEEEFHRQVRQEWARRPRLAAVGSCCLLGAISGDTLYVANLGDSRAVLGRRVGGGGGGAAVAERLSAEHNAASEEVRRELAALNPDDAQIVVHARGAWRVKGIIQVSRSIGDFYLKKPEYSLDPLFRQVGPPIALKRPALSAEPSVQVRKLKPNDLFLIFASDGLWEHLSDDAAVQIVFKNPRTGIANRLVKAALKEAARKREVRYRDLRTIDKGVRRHFHDDISVVVVFLDRHRERRHTRVVDSSSNCISAPVDIYSSNTHQSAEPLHG

SEQ ID NO: 3082 - protein, 339 aa, Triticum aestivum
DGQPRPSEGPRRHGRSASPSATLVGVTTATAARRLRFLRSALSPRPRSPGSRGRDRGGDPEGVRRGGGGLPARGPPGLAQAPADGRRRLLLPARAIAGDTLYVANLGDSRAVLGRRVVGGGVAVAERLSTDHNVASEEVRMEVSSHNPDDAQIVVHTRGAWRIKGIIQVSRSIGDVYLKKPEYSLDPLFRQIGPVIALKRPALSAEPQIHVRKLKPNDQFIIFASDGLWEHLSDDDAVQIVFKNPRTGIANRLVRSALKEATKKREVSVHDLRTIERGVRRHFHDDISVVVVYLDRHRGRRQTRVVDSSSNCTSAPVDIYSSSSSIQSVQPRQAYRDSG

SEQ ID NO: 3083 - protein, 367 aa, Panicum virgatum
MLRAVARCCGHWPPSAAAADGMLWQTELRPHAAGEFSMAAAQANLAMEDQAQVLASPSDTLVGVYDGHGGADASRFLRSRLFPHVQRFATEQGGMSTEVIRRAFSETEEEFHTQVRQEWRRRPRMAAVGSCCLLGAISGDTLYVANLGDSRAVLGRRVVGGGVAVAERLSSEHNTASEEVRRELAALNPDDAQIVVHARGAWRVKGIIQVTRSIGDFYLKKPEYSLDPLFREVGPPIALKRPALSAEPSIQVHKLNPNDLFLIFASDGLWEHLSDDDAVQIVFKNPRTGIANRLVKAALKEATRKREVRYRDLRTIERGVRRHFHDDISVVVVYLDRHRERRHTRVIDSSSNCTSAPVDIYSSNTVL

SEQ ID NO: 3084 - protein, 367 aa, Zea mays
MLRALAARCCGHWPPGAAAADGMLWQAELRPHAAGEFSMAAAQANLAMEDQAQVLASPAATLVGVYDGHGGADASRFLRSRLFLHVQRVVQEQGGMSAEAIRSAFGAAEEEFHRQVRQEWRSRPRLAAVGSCCLLGAISGDTLYVANAGDSRAVLGRRVPGGGAAVAERLSAEHNAACEEVRRELAALNPDDAQIVVHARGAWRVKGIIQVSRSIGDFYLKKPEYSLDPLFRQVGAPIALKRPALSAEPSVQVRKLKPNDLFLIFASDGLWEHLSDDAAVQIVFKNPRTGIASRLVKAALKEATRKREVRYRDLRTIERGVRRHFHDDISVVVVYLDGHRERRHTRVVDSSSNCTSAPVDIHSSNSR

SEQ ID NO: 3085 - protein, 234 aa, Triticum aestivum
MKFGKWLKRQIEQSLPAWKDEFLSYNELKPVIGAVSPAEFVARLDVEIEKINAFFIEQEEFFIITHRELQGAIRSALERKPAVPASAHEAEIAAIRREIVNFHGEMVLLLNYSSVNYIGLAKILKKYDKRTGAGIRLAVIETVLVQPFFTAEAVSLMVRECEAMMEAVFPTAPGEGQAAARRDREALVAAEQRIFRNTVSALLAMQDVRSGSSTRGRHSLPPLNLPDSDWLRSF

SEQ ID NO: 3086 - protein, 234 aa, Secale cereale
MKFGKWLKRQIEQSLPAWKDEFLSYNELKPVIGAVSPAEFVALLDAQIEKINAFFIEQEEFFIIIHRELQGAIRSALERKPAVPAGAHEAEIAAIRREIVNFHGEMVLLLNYSSVNYIGLAKILKKYDKRTGAGLRLAVIETVLVQPFFTAEAVSLMVRECEAMMEAVFPTAPGEGQAAARRDREALVAAEQRIFRNTVSALLAMQDVRSASSTRGSHSLPPLNLPDSDWLRSF

SEQ ID NO: 3087 - protein, 427 aa, Secale cereale
MASSCCGKRPRPAVPLLLALLVVSCSSVSASGGGGRGNGTRTTEFRSGDELRAYRSIVARMDKMKKASVKTIQSSDGDVIHCVPAHLQPAFDHPTLRGQKPEAEPEERPKISADAAEEEEGDAVFPQAWSDGGESCPGGTVPIRRTRESDLRRYTGSLRRYGMKPRAAGVRRDSTSDGHEHAVGYVTGDQFYGAKASLNVWPARVASAAEFSLSQIWVISGTFGNDLNTIEAGWQVSPQLYGDNSPRFFTYWTSDAYQATGCYNLHCSGFVQTNRRISIGAAISPASAYNGRQFDISLLIWKDPRRGHWWLQLGSGPLVGYWPSSLFSHLGGHANMVQFGGEVVNTRPSGSHTPTQMGSGHFPREGFNRAAYFRNVQVVDWDNNLLPARDLRLVADHPTCYGIQGGYNRAWGNYFYYGGPGRNVHCP

SEQ ID NO: 3088 - protein, 444 aa, Brachypodium distachyon
MASSGGKRRPRPTIFSWFVPLLLLLACSSSLSVSADNGGGSGGGNGGGNGTTHEFRSGDELRAYQRIVARMARTKKAAVKTIQSPDGDVIDCVPAHLQPAFDHPTLRGQKPEDEPVYRPNITGGAAAKNDDTVFPQAWSDGGGEPCPGGTVPIRRTTERDLLRHSAATGSLRRFAMKPPRARNVVRRDSTDDGHEHAVGYVTGDQFYGAKASLNVWPAKVASAAEFSLSQIWVISGTFGNDLNTIEAGWQVSPQLYGDNSPRFFTYWTSDAYQATGCYNLHCSGFVQTNSRIAIGAAISPASAYNGRQFDIALLIWKDPRRGHWWLQLGDGAGPLVGYWPSSLFTHLGGHANMVQFGGEVVNTRPKGAHTPTQMGSGHFPREGFNRAAYFRNLQVVDWDNNLIPAAGLRLVADHPACYGVQGGYNRAWGNYFYYGGPGRNVRCP

SEQ ID NO: 3089 - protein, 427 aa, Oryza sativa
MASSGCSSNRLRQTIVVALLLLASSSCLASAKHRGNGTTTTVPFHGKDELRRYRKIMAQVARLKKASVKTIQSPDGDVIDCVPAHLQPAFEHPKLRGQKPEAEPEERPKVGGAAAAEAEEEAVFPQAWTDGGESCPEKTVPVRRTRRRDVLRSSSAVRFGMKQPRAAGVVRRDSTSDGHEHAVGYVTGDQFYGAKASLNVWSARVATAAEFSLSQIWVISGSFGNDLNTIEAGWQVSPELYGDNNPRFFTYWTTDAYQATGCYNLHCSGFVQTNNRIAIGAAISPTSVYNGRQFDISLLIWKDPRRGHWWLQLGSGPLVGYWPSSLFTHLGGHANMVQFGGEVVNTRPSGSHTPTQMGSGHFPREGFNRAAYFRNLQVVDWDNNLLPAAALRLVADHPSCYDIQGGYNRAWGNYFYYGGPGRNVRCP

SEQ ID NO: 3090 - protein, 324 aa, Secale cereale
MFIQKAWRTAAFGLYGFTQFTKSGFVEHAKKFREEDMQIRLDGKNCLVTGANSGLGFATAQGLASHGATVYMLCRNKERGETALNEIRSKTGNMNVHLEICDLSSINEVKSFATKFSSSEKPLHVLVNNAGLLEHKRTTTPEGLELNFAVNVAATYTLTELVMPLLEKAAPDARVITVASGGMYTEPLNTNLQYSESEFDGTKQYARNKRVQVALTEWWAEKYSNKGVGFYSMHPGWADTPGVSKSLPGLSEKLSGNLRSNEEGADTVVWLALQPKEKLVPGAFYFDRAEAQKHLKFAGTAASHEQIGSIVDSIRSICNLPANT

SEQ ID NO: 3091 - protein, 324 aa, Secale cereale
MFIQKAWRTAAFGLYGFTQFTKSGFVEHAKKFREEDMQIRLDGKNCLVTGANSGLGYATAQGLASHGATVYMLCRNKERGETALNEIRSKTGNMNVHLEICDLSSINEVKSFATKFSSSEKPLHVLVNNAGLLEHKRTTTPEGLELNFAVNVAATYTLTELVMPLLEKAAPDARVITVASGGMYTEPLNTNLQYSESEFDGTKQYARNKRVQVALTEWWAKKYSNKGVGFYSMHPGWADTPGVSKSLPGLSEKLSGNLRSNEEGADTVVWLALQPKEKLVPGAFYFDRAEAQKHLKFAGTAASHEQIGSIVDSIRSICNLPANT

SEQ ID NO: 3092 - protein, 324 aa, Pseudoroegneria spicata
MFIQKAWRTAAFGLYGFTQFTKSGFVEHAKKFREEDMQIRLDGKNCLVTGANSGLGYATAQGLASHGATVYMLCRNKERGETALNEIRSKTGNMNVHLEICDLSSINEVKSFATKFSSSEKPLHVLVNNAGLLEHKRTTTPEGLELNFAVNVAATYTLTELVMPLLEKAAPDARVITVASGGMYTEPLNTNLQYSESEFDGTKQYARNKRVQVALTEWWAEKYSNKGVGFYSMHPGWADTPGVSKSLPGLSEKLSGNLRSNEEGADTVVWLALQPKEKLVPGAFYFDRAEAQKHLKFAGTAASHEQIGSIADSIRSICNLTANA

SEQ ID NO: 3093 - protein, 324 aa, Triticum aestivum
MFIQKAWRTAAFGLYGFTQFTKSGFVEHAKKFREEDMQIRLDGKNCLVTGANSGLGYATAQGLASHGATVYMLCRNKERGETALNEIRSKTGNMNVHLEICDLSSINEVKSFATKFSSLEKPLHVLVNNAGLLEHKRTTTPEGLELNFAVNVAATYTLTELVMPLLEKAAPDARVFTVASGGMYTEPLNTNLQYSESEFDGTKQYARNKRVQVALTEWWAEKYSNKGVGFYSMHPGWADTPGVSKSLPGLSEKLSGNLRSNEEGADTVVWLALQPKEKLVPGAFYFDRAEAQKHLKFAGTASSHEQIGSIVDSIRSICSLPANP

SEQ ID NO: 3094 - protein, 320 aa, Oryza sativa
MFIQKAWRTAAFGVYGFTQFTKSGFVEHAKKFREEDMQIRLDGKNCLVTGANSGIGFATAEGLASRGATVYMLCRNKERGETALSQIRSKTGNMNVHLEICDLSSISEVKSFATKFSSTDKPLHVLVNNAGLLEHKRVTTPEGLELNFAVNVAATYTLTELVMPLLEKAAPDARVITVSSGGMYTEPLNKDLQFGENNFDGTQQYARNKRVQVALTERWSEKCSNKGVGFYSMHPGWADTPGVSKSLPGLSEKLSGNLRSNDEGADTVIWLALQPKEKLTSGSFYFDRAEAPKHLKFAGTAASHGQIGSIVDSLRSICGI

SEQ ID NO: 3095 - protein, 324 aa, Panicum virgatum
MFIQKAWRTASFGLYGFTQFTKSGFLEHAKKFREEDMQIRLDGKNCLVTGANSGIGFATAEGLASHGATVYMLCRNKERGEAALNQIRSKTGNENVHLEICDLSSINEVKSFAAKFSSMDKPLHVLVNNAGLLEHKRETTAEGLELNFAVNVAATYTLTELVMPLLEKAAPDARVITVASGGMYTEPLNKDLQFSEGNFDGTVQYARNKRIQVALTEWWAEKYSSKGVGFYSMHPGWADTPGVAKSLPGFSEKLSGNLRSNDEGADTVLWLALQPKDKLSPGAFYFDRAEAPKHLKFAGTMSSHSQINSIVDSIRSICGLPASG

SEQ ID NO: 3096 - protein, 324 aa, Setaria italica
MFIQKAWRTAAFGLYGFTQFTKSGFLEHAKKFREEDMLIQLDGKNCLVTGANSGIGFATAEGLASHGATVYMLCRNKERGEAALNQIRSKTGNENVHLEICDLSSINEVKSFATKFTSMDKPLHVLVNNAGLLEHKRETTAEGLELNFAVNVAATYTLTELVMPLLEKAAPDARVITVASGGMYTEPLNKDLQFSEENFDGTRQYARNKRVQVALTEWWAEKYNSKGVGFYSMHPGWADTPGVSKSLPGLSEKLSGNLRSNDEGADTVLWLALQPKEKLSSGAFYFDRAEAPKHLKFAGTAPSHSQIKSVVDSIRSICGLPALG

SEQ ID NO: 3097 - protein, 324 aa, Panicum virgatum
MFIQKAWRTASFGLYGFTQFTKSGFLEHAKKFREEDMQIRLDGKNCLVTGANSGIGFATAEGLASHGATVYMLCRNKERGEAALNQIRSKTGNENVHLEICDLSSINEVKSFAAKFSSMDKSLHVLVNNAGLLEHKRETTAEGLELNFAVNVAATYTLTELVMPLLEKAAPDARVITVASGGMYTEPLNKDLQFSEGNFDGTVQYARNKRIQVALTEWWAEKYSSKGVGFYSMHPGWADTPGVAKSLPGFSEKLSGNLRSNDEGADTVLWLALQPKDKLSPGAFYFDRAEAPKHLKFAGTMSSHSQINSIVDSIRSICGLPASG

SEQ ID NO: 3098 - protein, 322 aa, Cenchrus ciliaris
MFIQKAWRTAAFGLYGFTHFTKSGFLEHAKKFREEDMLIRLDGKNCLVTGANSGIGFATAEGLASHGATVYMLCRNKERGEAALNQIRSKTGNDNVHLEICDLSSINEVKSFTTKFTSMDKPLHILVNNAGLLEHKRETTAEGLELNFAVNVAATYTLTELVMPLLEKAAPDARVITVASGGMYTEPLNKDLQFSEENFDGTRQYARNKRIQVALTEWWAEKYKGVGFYSMHPGWADTPGVAKSFPGLSEKLSGNLRSNDEGADTVLWLALQPKEKLSSGTFYFDRAEAPKHLKFAGTAASHSQINSIVDSIRSICGLPPLG

SEQ ID NO: 3099 - protein, 335 aa, Leymus cinereus x Leymus triticoides
MPVMFFFFLRILLVAQAWRTAAFGLYGFAQFTKSGFVEHAKKFREEDMQIRLDGKNCLVTGANSGLGYATAQGLASHGATVYMLCRNKERGETALNEIRSKTGNMNVHLEICDLSSINEVKSFAKKISSSEKPLHVLVNNAGLLEHKRTTTPEGLELNFAVNVAATYTLTELVMPLLEKAAPDARVITVASGGMYTEPLNTNLQYSESEFDGTKQYARNKRVQVALTEWWAQKNSNKGVGFYSMHPGWADTPGVSKSLPGLSEKLSGNLRSNEEGADTVVWLALQPKEKLVPGAFYFDRAEAQKHLKFAGTAASHEQIGSIVDSIRSICNLPANP

SEQ ID NO: 3100 - protein, 324 aa, Zea mays
MFIQKAWRTAAFGLYGFNHFTKSGFLEHAKKFREEDMQIRLDGKNCLVTGANSGIGFATAEGLASHGATVYMVCRNKERGEAALNQIRSKTGNANVHLEICDLSSINQVKSFATKFTSMDKPLHVLVNNAGLLEHKHETTAEGLELNFAVNVAATYTLTELVMPSLEKAAPDARVITVASGGMYTEPLNKDLQFTEGTFDGTQQYARNKRVQVALTEWWAEKSGDRGVGFYAMHPGWADTPGVAKSLPGLSERLSGNLRTNDEGADTVVWLALQPKEKLASGAFYFDRAEAPKHLKFAGTADSHAQINPIVDSIRSICGLSVNG

SEQ ID NO: 3101 - protein, 394 aa, Secale cereale
MELQTSGRPIEVLMEKVLSMNIVSSDYFKELYKIKTYHEVIDEIYNQVDHVEPWMTGNCRGPSTAFCLLYKLFTMKLTVNQMHGLLKHPDSPYIRAIGFLYLRYAADPKTLWTWYEPYIQDDEEFSPGSNGKMTTMGVYVRDVILGQYYFDSLLPRVPLLILRQVTAHLEKMKLPTKQSGITGDSSRLGSDDTARRPPSVKASLSVSFGQRAPHRASTRDSSPVRKTLPSVRERERSHDGGHGKSPPRMHRSQSRERSRDTERDRSDRDRGRYKDREHGRHSRDNRDRDYRRSSYSDRDVERRGHERRDRDSDRNGRSSGRRSRSRSRSPSRGRTNGDSHRSSPFGKAPESSNLAKLKDLYGDATNAKDDAGDDRSRRDSGTEEVIRLGGARWR

SEQ ID NO: 3102 - protein, 394 aa, Secale cereale
MELQTSGRPIEVLMEKVLSMNIVSSDYFKELYKIKTYHEVIDEIYNQVDHVEPWMTGNCRGPSTAFCLLYKLFTMKLTVNQMHGLLKHPDSPYIRAIGFLYLRYAADPKTLWTWYEPYIQDDEEFSPGSNGKMTTMGVYVRDVILGQYYFDSLLPRVPLLILRQVTAHLEKMKLPTKQSGITGDSSRLGSDDTARRPPSVKASLSVSFGQRAPHRASTRDSSPVRKTLPSVRERERSHDGGHGKSPPRMHRSQSRERSRDTERDRSDRDRGRYKDREHGRHSRDNRDRDYRRSSYSDRDVERRGHERRDRDSDRNGRSTGRRSRSRSRSPSRGRTNGDSHRSSPFGKAPESSNLAKLKDLYGDATNAKDDAGDDRSRRDSGTEEVIRLGGARWR

SEQ ID NO: 3103 - protein, 396 aa, Triticum aestivum
MELQTSGRPIEVLMEKVLSMNIVSSDYFKELYKIKTYHEVIDEIYNQVDHVEPWMTGNCRGPSTAFCLLYKLFTMKLTVNQMHGLLKHPDSPYIRAIGFLYLRYAADPKTLWTWYEPYIQDDEEFSPGSNGKMTTMGVYVRDVILGQYYFDSLLPRVPLLILRQVTAHLEKMKLPTKQSGITGDSSRLGSDDTARRPPSVKASLSVSFGQRAPHRASTRDSSPVRKTLPSVRERERSHDGGHAKSPPRKHRSQSRERSRDIDRDRSDRDRGRYKDREHGRHSRDNRDRDYRRSSYSDRDVERRSHERRDRDSDRNGRSSGRRSRSRSRSRSPSRGRTNGDSHRSSPFGKAPESSNLAKLKDLYGDATNAKDDAGDDRSRRDSGTEEVIRLGGARWR

SEQ ID NO: 3104 - protein, 392 aa, Sorghum bicolor
MEIQSSGRSIEGLMEKVLSVNILSSDYFKELFKYKTYHEVVDEIYNQVDHVEPWMTGNCRGPSSAFCLLYKLFTMKLTVKQMHGLLKHQDSPYIRAIGFLYLRYVAEPKTLWSWYEPYIKDGEEFAPGSNGKSTTMGVYVRDLLLGQYYFDSLLPRVPLPILRQVTSHLEKLKLPTKQSGMTGDSNRLESNDTARRPPSVKASLSVSFGQRAPHRASTRDSSPVRRTLPSKQDKERSYDGDRAKSPPRKRRSRSSERDHDSERDRSDRDRGRYKDREHDRYARDHRDRDHHRSSYSDRDDERRGREKRDRDSDRNRHSSSRRSRSRSPVRGRTDGDKHRSSPFGRAPESSNLAKLKDLYGDATNTKNDAGDDRAHRDSGTEEVIRLGGARWR

SEQ ID NO: 3105 - protein, 250 aa, Triticum aestivum
MAASTSFTPGQLSAFLGFLWVLAAWVYAEVLFHRKNAASLKTHSDINLSDMDSSSNKGEDQTMLLEEGGQVAGAKPVYASFTSQMLRLFCMDETLLLEHRLTLRATSELGGHLLYFYICDRTNIFGESEKNYSRDLFLFLYFLLIIVAAITSFKVHQDKSTFTGKSVLYLNRHQTEEWKGWMQVLFLMYHYFNAKEIYNAIRVFIAAYVWMTGFGNFSYYYVRKDFSLGRFCSDDVAPQFLCGILLYCPK

SEQ ID NO: 3106 - protein, 540 aa, Triticum aestivum
MAASTSFTPGQLSAFLGFLWVLAAWVYAEVLFHGKNAASLKTRHSDINLSDMDSSSNKGEDQTMLLEEGGQVAGAKPVYASFTSQMLRLFCMDQILLLEHRVTLRAISELGGHLLYFYICDRTNIFGESEKNYSRDLFLFLYFLLIIVAAITSFKVHQDKSTFTGKSILYLNRHQTEEWKGWMQVLFLMYHYFNAKEIYNAIRVFIAAYVWMTGFGNFSYYYVRKDFSLGRFAQMMWRLNFFVAFCCIVLNNDYTLYYICPMHTLFTLMVYGALGILNKYNEIRSVIAIKFVGCFLVVILVWEIPGVFEIVWSPFTFLLGYDDPSKPDLPRLHEWHFRSGLDRYIWIVGMIYAYYHPTVEKWMEKLEEAETRTKLYIKASIVTVSLTAGYLWYEYIYKLDKITYNKYHPYTSWIPITVYICLRNFTQEFRACSLTLFAWLGKITLETYISQFHIWLRSKVPNGQPKWLLTIIPDYPLLNFMLTTALYVAVSHRLFELTNTLKIAFVPRDNKHLSYNFVAGIAISVALYSVSFALVGIAGY

SEQ ID NO: 3107 - protein, 539 aa, Secale cereale
MAASTSFTPGQLSAFLGFLWVLAAWVYAEVLFHRKNAASLKTHSDINLSDMDSSSNKGDDQTMLLEEGGQVAGAKPVYASFTSQMLRLFCMDQTLLLEHRLTLRAISELGGHLLYFYVCDRTNIFGESEKNYSRDLFLFLYFLLIIVAAITSFKVHQDKSTFTGKSVLYLNRHQTEEWKGWMQVLFLMYHYFNAKEIYNAIRVFIAAYVWMTGFGNFSYYYVRKDFSLGRFAQMMWRLNFFVAFCCIVLNNDYTLYYICPMHTLFTLMVYGALGILNKYNEIRSVIAIKFVGCFLVVILVWEIPGVFEIVWSPFTFLLGYDDPSKPDLPRLHEWHFRSGLDRYIWIVGMIYAYYHPTVEKWMEKLEEAETRTKLYIKASIVTVSLTAGYLWYEYIYKLDKITYNKYHPYTSWIPITVYICLRNFTQEFRACSLTLFAWLGKITLETYISQFHIWLRSKVPNGQPKWLLTIIPDYPLLNFMITTALYVVVSHRLFELTNTLKIAFVPRDNKHLSYNFVAGIAISVALYSVSFALVGIAGY

SEQ ID NO: 3108 - protein, 540 aa, Triticum aestivum
MAASTSFTPGQLSAFLGFLWVLAAWVYAEVLFHRKNAASLKTRHSDINLSDMDSSSNKGEDQTMLLEEGGQVAGAKPVYASFTSQMLRLFCMDETLLLEHRLTLRATSELGGHLLYFYICDRTNIFGESEKNYSRDLFLFLYFLLIIVAAVTSFKVHQDKSTFTGKSVLYLNRHQTEEWKGWMQVLFLMYHYFNAKEIYNAIRVFIAAYVWMTGFGNFSYYYVRKDFSLGRFAQMMWRLNFFVAFCCIVLNNDYTLYYICPMHTLFTLMVYGALGILNKYNEITSVIAIKFVGCFLVVILVWEIPGVFEIVWSPFTFLLGYDDPSKPDLPRLHEWHFRSGLDRYIWIVGMIYAYYHPTVEKWMEKLEEAETRTKLYIKASTVTVSLTAGYLWYEYIYKLDKITYNKYHPYTSWIPITVYICLRNFTQEFRACSLTLFAWLGKITLETYISQFHIWLRSKVPNGQPKWLLTIIPDYPLLNFMLTTALYVAVSHRLFELTNALKIAFVPRDNKRLSYNFVTGIAISVALYSVSFALVGIAGY

SEQ ID NO: 3109 - protein, 535 aa, Hordeum vulgare
LFCTSSQLSAFLGFLWVLAAWVYAEVLFHRKNAASLKTHSDINLSDMDSSSNKGEDQTMLLEEGGQVAGAKPVYASFTSQMLRLFCMDQTLLLEHRLTLRAISELGGHLLYFYICDRTNIFGESGKNYSRDLFLFLYFLLIIVAAITSFKIHQDKSTFTGKSILYLNRHQTEEWKGWMQVLFLMYHYFNAKEIYNAIRVFIAAYVWMTGFGNFSYYYVRKDFSLGRFAQMMWRLNFFVAFCCIVLNNDYTLYYICPMHTLFTLMVYGALGILNKYNEIRSVIAIKFVGCFLVVILVWEIPGVFEIVWSPFTFLLGYDDPSKPDLPRLHEWHFRSGLDRYIWIVGMIYAYYHPTVEKWMEKLEEAETRTKLYIKASIVTVSITAGYLWYEYIYKMDKITYNKYHPYTSWIPITVYICLRNFTQEFRACSLTLFAWLGKITLETYISQFHIWLRSKVPNGQPKWLLTIIPDYPLLNFMLTTALYVAVSHRLFELTNTLKIAFVPRDNKHLSYNFVAGIAISVALYSVSFALVGIAGY

SEQ ID NO: 3110 - protein, 554 aa, Setaria italica
MAEAVASAGGLAVAAASTSVTPGQVSAILGFLWVFAAWAYAEVLFHRKNAASIKTRHSDVNLAVMDNSSVKGEDQTLLLEEGGQAVAVKPAYASFTSQILRLFFMDQMLLLENRLTLRAISEFGGYLLYFYICDRTDLLGESAKNYSRDLFLFLYFLLIIVAAMTSFKVHQDKSAFTGKSILYLNRHQTEEWKGWMQVLFLMYHYFNAKEIYNAIRVFIAAYVWMTGFGNFSYYYVRKDFSLGRFAQMMWRLNFFVIFCCIVLNNDYTLYYICPMHTLFTLMVYGALGILNKYNEIRSVMAMKFVACFLVVILVWEVPGVFDIVWSPFTFLLGYTDPSKPDLPRLHEWQFRSGLDRYIWIVGMIYAYYHPTVEKWMEKLEETELRTKLYIKGSIVTVSLTAGYLWYEYIYKLDKITYNKLHPYTSWIPITVYICLRNFTQEFRSFSLTLFAWLGKITLETYISQFHIWLRSRVPNGQPKWLLAIIPNYPLLNFMLTTAIYVAVSHRLFELTNTLKVAFVPSRDNKRLSYNFVAGIVISVALYLVSFVLVGIAGY

SEQ ID NO: 3111 - protein, 553 aa, Panicum virgatum
MAEAVASAGGLAMAAASTSLTPGQVSAILGFLWVFAAWAYAEVLFHRKNAASIKTRYSDVNLAVMDNSSVKEDQTLLLEEGGQAVAAKPAYNSFTSQMLRLFFMDQMLLLENRLTLRAISEFGGYLLYFYICDRTDLLGESAKNYSRDLFLFLYFLLIIVSAMTSFKVHQDKSALTGKSILYLNRHQTEEWKGWMQVLFLMYHYFNAKEIYNAIRVFIAAYVWMTGFGNFSYYYVRKDFSLGRFAQMMWRLNFFVILCCIVLNNDYTLYYICPMHTLFTLMVYGALGILNKYNEIRSVMAMKFVACFLVVILVWEVPGVFDIVWSPFTFLLGYTDPSKPDLPRLHEWQFRSGLDRYIWIVGMIYAYYHPTVEKWMEKLEETELRTKLYIKGSIVTVSLTAGYLWYEYIYKLDKITYNKLHPYTSWIPITVYICLRNFTQEFRSFSLTLFAWLGKITLETYISQFHIWLRSRVPNGQPKWLLTIIPNYPLLNFMLTTAIYVAVSHRLFELTTTLKMAFVPSRDNKRLSYNFVAGITISVALYCVSFVLVGIAGY

SEQ ID NO: 3112 - protein, 543 aa, Pennisetum glaucum
AVATASTSVTPGPVSAILGFLWVFAAWAYAEVLFHRKNAAAIKTRHSDVNLAVMDNSSVKEEDQTLLLEEGGQAVAAKPAYASFTSQILRLFFMDQILLLENRLTLRAISEFGGYLLYFYICDRTDLLGESAKNYSRDLFLFLYFLLIIVAAMTSFKVHQDKSALTGKSILYLNRHQTEEWKGWMQVLFLMYHYFNAKEIYNAIRVFIAAYVWMTGFGNFSYYYVRKDFSLGRFAQMMWRLNFFVIFCCIVLNNDYTLYYICPMHTLFTLMVYGALGILNKYNEIRSVMAMKFVACFLVVILVWEVPGVFDIVWSPFTFLLGYTDPSKPDLPRLHEWQFRSGLDRYIWIVGMIYAYYHPTVEKWMEKLEETELRTKLYIKGSVVTVSLTAGYLWYEYIYKLDKITYNKLHPYTSWIPITVYICLRNFTQEFRSFSLTLFAWLGKITLETYISQFHIWLRSRVPNGQPKWLLAIIPNYPLLNFMLTTAIYVAVSHRLFELTNTLKVAFVPSRDNKRLSYNFVAGIAISVALYFVSFVLVGIAGY

SEQ ID NO: 3113 - protein, 541 aa, Panicum virgatum
MAAASTSVTPGQVSAILGFLWVFAAWAYAEVLFHRKNAASIKTRYSDVNLAVMDNSSVKEDQTLLLEEGGQAVAAKPAYNSFTSQMLRLFFMDQMLLLENRLTLRAISEFGGYLLYFYICDRTDLLGESAKNYSRDLFLFLYFLLIIVSAMTSFKVHQDKSALTGKSILYLNRHQTEEWKGWMQVLFLMYHYFNAKEIYNAIRVFIAAYVWMTGFGNFSYYYVRKDFSLGRFAQMMWRLNFFVILCCIVLNNDYTLYYICPMHTLFTLMVYGALGILNKYNEIRSVMAMKFVACFLVVILVWEVPGVFDIVWSPFTFLLGYTDPSKPDLPRLHEWQFRSGLDRYIWIVGMIYAYYHPTVEKWMEKLEETELRTKLYIKGSIVTVSLTAGYLWYEYIYKLDKITYNKLHPYTSWIPITVYICLRNFTQEFRSFSLTLFAWLGKITLETYISQFHIWLRSRVPNGQPKWLLTIIPNYPLLNFMLTTAIYVAVSHRLLELTNTLKMAFVPSRDNKRLSYNFVAGITISVALYCVSFVLVGIAGY

SEQ ID NO: 3114 - protein, 540 aa, Oryza sativa
MAASTSLTPGQVSALLGFLWVFTAWAYAEVLYYRKNAASIKAHSDVNLAVMDSSSNKGEDQVMLLEEGVQAPVQKPVYASLTSQMFRLFLLDQALILENRLTLRAISEFGGHLLYFYICDRTNLLGESAKNYSRDMFLFLYFLLIIVAAMTSFKVHQDKSSFTGKSILYLNRHQTEEWKGWMQVLFLMYHYFNAKEIYNAIRVFIAAYVWMTGFGNFSYYYVRKDFSLARFAQMMWRLNFFVAFCCIVLNNDYTLYYICPMHTLFTLMVYGALGILNKYNEIGSVMAIKFVACFLVVILIWEIPGVFEIVWSPFTFLLGYTDPSKPDLPRLHEWHFRSGLDRYIWIVGMIYAYYHPTVEKWMEKLEEAETKTKLYIKALIVSIALTAGCLWYEYIYKLDKITYNKYHPYTSWIPITVYICLRNFTQEFRCCSLTLFAWLGKITLETYISQFHIWLRSKVPNGQPKWLLTIIPNYPMLNFMLTTAIYVAVSHRLFELTNTLKIAFVPSRDNKRLSYNFVAGIAISVALYSLSFLIVGVAGY

SEQ ID NO: 3115 - protein, 541 aa, Sorghum bicolor
MEPSTSVTPGQVSAILGFLWVFAAWAYAEVLFHRKNTASIKTRHSDVNLAVMDNISVKAEDQTMLLEEGGQAVVAKPAYTSLTSQILRLIFMDQMLLLENRLTLRAISEFGGYLLYFYICDRTNLLGESAKNYSRDLFLFLYFLLIIVAAMTSFKVHQDKSAFTGKSILYLNRHQTEEWKGWMQVLFLMYHYFNAKEIYNAIRVFIAAYVWMTGFGNFSYYYVRKDFSLGRFAQMMWRLNFFVIFCCIVLNNDYTLYYICPMHTLFTLMVYGALGILNKYNEIRSVMAMKFVACFLVVVLVWEVPGVFDIVWSPFTFLLGYTDPSKPDLPRLHEWQFRSGLDRYIWIIGMIYAYYHPTVEKWMEKLEETEMRTKLYIKASIVTVSLMAGYLWYEYIYKLDKITYNKLHPYTSWIPITVYICLRNFTQEFRSFSFTLFAWLGKITLETYISQFHIWLRSSVPNGQPKWLLSIIPNYPLLNFMLTTAIYVAVSHRLFELTNTLKTVFVPNRDNKRLSYNFVAGAAISAALYFVSFVLIGIAGY

SEQ ID NO: 3116 - protein, 540 aa, Zea mays
MDSSTSVSPGQVSAILGFLWVFAAWAYAEVLFHRKNTASIKTHSDVNLAVMDDSSVKAEDQTMLLEEGGQAMAAKPAYTSLTSQILRLIFMDQLLLLENRLTLRALSEFGGYLLYFYICDRTNLLGESAKNYSRDLFLFLYFLLIIVAAMTSFKVHQDKSSFTGKSVLYLNRHQTEEWKGWMQVLFLMYHYFNAKEIYNAIRVFIAAYVWMTGFGNFSYYYVRKDFSLGRFAQMMWRLNFFVIFCCIVLNNDYTLYYICPMHTLFTLMVYGALGILNKYNEIRSVMAMKFVACFLVVVLVWEVPGVFDIVWSPFTFLLGYTDPSKPDLPRLHEWQFRSGLDRYIWIVGMIYAYYHPTVEKWLEKLEETEMRTKLYIKTSIVTVSMMAGYLWYEYIYKLDKITYNKLHPYTSWIPITVYICLRNFTQEFRGFSLTLFAWLGKITLETYISQFHIWLRSSVPNGQPKWLLSIIPNYPLLNFMLTTAIYVAVSHRLFELTNTLKMVFVPNRDNKRLSYNFVAGTAISAALYFVSFVLIGIAGY

SEQ ID NO: 3117 - protein, 544 aa, Saccharum officinarum
MEPSTAVTPGQVSAILGFLWVFAAWAYAEVLFHRKNTASIKTRHSDVNLAVMDNISVKAEDQTMLLEEGGQAVVAKPAYTSLTSQMLRLIFMDQMLLLENRLTLRAISEFGGYLLYFYICDRTNLLGESAKNYSRDLFLFLYFLLIIVAAMTSFKVHQDKSAFTGKSILYLNRHQTEEWKGWMQVLFLMYHYFNAKEIYNAIRVFIAAYVWMTGFGNFSYYYVRKDFSLGRFAQMMWRLNFFVIFCCIVLNNDYTLYYICPMHTLFTLMVYGALGILNKYNEIRSVMAMKFVACFLVVVLVWEVPGVFDIVWSPFTFLLGYTDPSKPDLPRLHEWQFRSGLDRYIWIIGMIYAYYHPTVEKWMEKLEETEMRTKLYIKASIVTVSLTAGYLWYEYIYKLDKITYNKLHPYTSWIPITVYICLRNFTQEFRSFSLTLFAWLGKITLETYISQFHVWLRSSVPNGQPKWLLSIIPNYPLLNFMLTTAIYVAVSHRLFELTNTLKTVFVPNRDNKRLSYNFVAGTAISAALYFVSFVLIGIAGYYKV

SEQ ID NO: 3118 - protein, 448 aa, Oryza sativa
MWVAERVVGERRMREIQRFARNAKLTVVCLLLTVVVLRGTVGAGKFGTPQQDLIELRHRFISHPHRALAEHHDALSRGGGSSSSSGRAAQRDDEPDPPPRTLRDPPYTLGPKISDWDEQRAAWHRRHPETPPFVNDVKPRVLLVTGSSPKPCENPVGDHYLLKSIKNKMDYCRVHGLEIFYNMALLDAEMAGFWAKLPLLRALLLAHPEIEFLWWMDSDAMFSDMAFELPWERYGPYNLIMHGWDEMVYDDKNWIGLNTGSFLLRNCQWSLDFLDTWAPMGPKGPVRIEAGKVLTKYLKDRPVFEADDQSAMVYILATEREKWGDKVYLENGYYLHGYWGILVDRYEEMLENYHPGLGDHRWPLVTHFVGCKPCGKFGDYPVERCLKQMERAFNFGDNQILQMYGFTHKSLGSRKVKRIRNETSNPLDVKDELGLLHPAFKAMKTTST

SEQ ID NO: 3119 - protein, 447 aa, Zea mays
MWAERVVGERRMRQIQRFARNAKLTVVCLLLTVVVLRGTVGAGRFGTPQQDLIELRQHFVSHPHRALAEHHDARSRASTTTTSSSSSSARRDDDPDPPPRTLRDPPYTLGPKISDWDEQRAAWHRRHPETPPFLNDIKPRVLLVTGSSPKPCENPVGDHYLLKSIKNKMDYCRVHGIEVFYNMALLDAEMAGFWAKLPLMRALLLAHPEVEFLWWMDSDAMFTDMAFELPWERYGPYNLIMHGWDEMVYDDKNWIGLNTGSFLLRNCQWSLDMLDTWAPMGPKGPVRIEAGKVLTKSLKDRPVFEADDQSAMVYILATQREKWGDKVYLENGYYLHGYWGILVDRYEEMLENYKPGLGDHRWPLVTHFVGCKPCGKFGDYPVERCLKNMDRAFNFGDNQILQMYGFTHKSLASRRVKRTRNETSNPLETKDELGLLHPAFKAVKTST

SEQ ID NO: 3120 - protein, 446 aa, Sorghum bicolor
MWAERVVGERRMRQIQRFARNAKLTVVCLLLTVVVLRGTVGAGRFGTPQQDLIELRQHFVSHPHRALAEHHDARSRASTTTTSSSSSVRRDDEPDPPPRTLRDPPYTLGPKISDWDEQRAAWHRRHPETPPFLNDIKPRVLLVTGSSPKPCENPVGDHYLLKSIKNKMDYCRVHGIEVFYNMALLDAEMAGFWAKLPLLRALLLAHPEFEFIWWMDSDAMFTDMAFELPWERYGPYNLIMHGWDEMVYDDKNWIGLNTGSFLLRNCQWSLDMLDTWAPMGPKGPVRIEAGKVLTKSLKDRPVFEADDQSAMVYILATQREKWGDKVYLENGYYLHGYWGILVDRYEEMLENYKPGLGDHRWPLVTHFVGCKPCGKFGDYPVERCLKNMDRAFNFGDNQILQMYGFTHKSLASRRVKRIRNETSNPLETKDELGLLHPAFKAVKTST

SEQ ID NO: 3121 - protein, 447 aa, Panicum virgatum
MWVERVVGERRMREIQRFARNAKLTAVCLLLTIVVLRGYVGAGRYGTPQQDLIELRQHFVSHPHRALAEHHDARSRGSATTTSSSSSSGRGDDEPDPPPRTLRDPPYTLGPKISDWDEQRAAWHRRHPETPPFLNDVKPRVLLVTGSSPKPCENPVGDHYLLKSIKNKIDYCRVHGIEIFYNMALLDAEMAGFWAKLPLIRALLLAHPEVEFLWWMDSDAMFTDMAFELPWERYGPYNLVMHGWDEMVYDDKNWIGLNTGSFLLRNCQWSLDMLDTWAPMGPKGPVRIEAGKVLTKSLKDRPVFEADDQSAMVYILATQREKWGDKVYLENGYYLHGYWGILVDRYEEMLENYKPGLGDHRWPLVTHFVGCKPCGKFGDYPVERCLKQMDRAFNFGDNQILQMYGFTHKSLASRRVKRIRNETSNPLEMKDELGLLHPAFKAVKTST

SEQ ID NO: 3122 - protein, 448 aa, Zea mays
MWAERVVGERRMRQIQRFARNAKLTVVCLLLTVVVLRGTVGAGRFGTPQQDLIELRQHFVSHPHRALAEHHDARSRASTTTTSSSSSSSSGRRDEPDPPPRSLRDPPYTLGPKISDWDEQRAAWHRRHPETPPFLNDIKPRVLLVTGSSPKPCENPVGDHYLLKSIKNKMDYCRVHGIEVFYNMALLDAEMAGFWAKLPLMRALLLAHPEVEFLWWMDSDAMFTDMAFELPWERYGPYNLIMHGWDEMVYDDKNWIGLNTGSFLLRNCQWSLDMLDTWAPMGPKGPVRIEAGKVLTKSLKDRPVFEADDQSAMVYILATQREKWGDKVYLENGYYLHGYWGILVDRYEEMLENYKPGLGDHRWPLVTHFVGCKPCGKFGDYPVERCLKNMDRAFNFGDNQILQMYGFTHKSLASRRVKRIRNETSNPLETKDELGLLHPAFKAVKTST

SEQ ID NO: 3123 - protein, 451 aa, Setaria italica
MWAERVVGERRMRQIQRFARNAKLTVVCLLLTVVVLRGTVGAGRFGTPQQDLIELRQHFVSHPHRALAEHHDARSRASTTTTTTSSSSSSSSGRGDDEPDPPPRTLRDPPYTLGPKISDWDEQRANWHRRHPETPPFLNDVKPRVLLVSGSSPKPCENPVGDHYLLKSIKNKIDYCRVHGLEIFYNMALLDAEMAGFWAKLPLMRALLLAHPEVEFIWWMDSDAMFTDMAFELPWERYGPYNLIMHGWDEMIYDDKNWIGLNTGSFLLRNCQWSLDMLDTWAPMGPKGPVRIEAGKVLTKSLKDRPVFEADDQSAMVYILATQREKWGDKVYLENGYYLHGYWGILVDRYEEMLENYKPGLGDHRWPLVTHFVGCKPCGKFGDYPVERCLKQMDRAFNFGDNQILQMYGFTHKSLASRRVKRIRNETSNPLEMKDELGLLHPAFKAVKTST

SEQ ID NO: 3124 - protein, 455 aa, Secale cereale
MWVAERVLGERRMREIQRFTRNAKLTVVCLMLTILVLRGTVGAGKFGTPQQDLSELRHRFISHPQRALSEHHDARSKASDDASAAQAQAAQAAGKAKARDDEPEPQPRSLRDPPYTLGPKISDWDEQRAAWNRRHPETPPFLNDVKPRVMLVTGSSPKPCENPVGDHYLLKSIKNKIDYCRIHGLEIFYNMALLDAELAGFWAKLPLLRALLLAHPEVEFFWWMDSDAMFTDMAFELPWERYGSYNFILHGWDEMVYDDKNWIGLNTGSFLLRNCQWSLDYLDTWAPMGPKGPVRIEAGKVLTKYLKDRPVFEADDQSAMVYILATQREKWGSKVYLENGYYLHGYWGILVDRYEEMLENYQPGLGDHRWPLVTHFVGCKPCSKFGDYPVERCLKQMDRAFNFGDNQVLHMYGFEHKSLASRRIKRIRNETSNPLDMKDDYGLLHPAFKAVKTTT

SEQ ID NO: 3125 - protein, 217 aa, Panicum virgatum
MGALRAVQPRHARLGRDGLRRQNWIGLNTGSFLLRNCQWSLDMLDTWAPMGPKGPVRIEAGKVLTKSLKDRPVFEADDQSAMVYILATQREKWGDKVYLENGYYLHGYWGILVDRYEEMLENYKPGLGDHRWPLVTHFVGCKPCGKFGDYPVERCLKQMDRAFNFGDNQILQMYGFTHKSLASRRVKRIRNETSNPLKMKDELGLLHPAFKAVKTST

SEQ ID NO: 3126 - protein, 440 aa, Pennisetum glaucum
MRQIQRFARNAKLTVVCLLLTVVVLRGTVGAGRFGTPQQDLIELRQHFVSHPHRALAEHHDAKSRSSSSTTTTTSSSSSSSGSSNDEPDPPPRTLRDPPYTLGPKISDWDEQRANWHRRHPETPPFLNDVKPRVLLVTGSSPKPCENPVGDHYLLKSIKNKIDYCRVHGLEIFYNMALLDAEMAGFWAKLPLMRALLLAHPEVEFVWWMDSDAMFTDMAFELPWERYGPYNLIMHGWDEMVYDDKNWIGLNTGSFLLRNCQWSLDMLDTWAPMGPKGPVRIEAGKVLTKSLKDRPVFEADDQSAMVYILATQREKWGDKVYLENGYYLHGYWGILVDRYEEMLENYKPGLGDHRWPLVTHFVGCKPCGKFGDYPVERCLKQMDRAFNFGDNQILQMYGFMHKSLGSRRVKRIRNETSNPLEMKDDIGLLHPAFKAVKTST

SEQ ID NO: 3127 - protein, 450 aa, Triticum aestivum
VGGGAGAGGAPDAGDPALHPERQAHRRLPHAHHPRAPRHRRGGKFGTPQQDLTELRHRFISHPQRALSEHHDARSKASDAQAQAAQAAGKAAARDDEPEPQPRSLRDPPYTLGPKISDWDEQRAAWNRRHPETPPFLNDVKPRVMLVTGSSPKPCENPVGDHYLLKSIKNKIDYCRIHGLEIFYNMALLDAELAGFWAKLPLLRALLLAHPEVEFFWWMDSDAMFTDMAFELPWERYGPYNFILHGWDEMVYDDKNWIGLNTGSFLLRNCQWSLDYLDTWAPMGPKGPVRIEAGKVLTKYLKDRPVFEADDQSAMVYILATQREKWGNKVYLENGYYLHGYWGILVDRYEEMLENYQPGLGDHRWPLVTHFVGCKPCSKFGDYPVERCLKQMDRAFNFGDNQVLHMYGFEHKSLASRRIKRIRNETSDPLDMKDDYGLLHPAFKALKTST

SEQ ID NO: 3128 - protein, 106 aa, Sorghum bicolor
MITRAKLVEQLREHQIRSAQSYSAALAVFSPNPHISSRRDLKVALIYAVLFCFLMVSCYVGLYLKWFRLSAMFVIFGILLPVSLKISRHRRLKRKRERRLLLPLSM

SEQ ID NO: 3129 - protein, 106 aa, Triticum aestivum
MITRAKLVEQLREHQIRSAQSYSAALAVFSPNPHIASRRDLRVALLYAFLFCFLMVSCYAALYLKWFKLSSLFVILGILLPVSLKISRHRRLRRKRERRLLLPLSM

SEQ ID NO: 3130 - protein, 106 aa, Secale cereale
MITRAKLVEQLREHQIRSAQSYSAALAVFSPNPHIASRRDLRVALLYAFLFCFLMVSCYAAIYVKWFKLSSLFVILGILLPVSLKISRHRRLKRKRERRLLLPLSM

SEQ ID NO: 3131 - protein, 106 aa, Setaria italica
MITRAKLAEQLREHQIRSAQSYSAALAVFSPNPHIASRRDLKVALIYAVLFSFLMVCCYVALYLKWFKLSAMFVIFGILLPVSLKISRHRRLKRKRERRLLLPLSM

SEQ ID NO: 3132 - protein, 106 aa, Oryza sativa
MITRAKLVEQLREHQIRSAQSYSAALAVFSPSPHIASRRDLKVALFYAILFCFVMVSCYVALYLRWFRLSAIFVVFGILLPVGLKISRHRRLKRKRERRLLLPLSM

SEQ ID NO: 3133 - protein, 106 aa, Panicum virgatum
MITRAKLVEQLRDHQIRSAQSYSAALAVFSPSPHIASRKDLKVALIYAVLFCFLMVSCYVALYLKWFKLSAMFVIFGILLPVSLKISRHRRLKRKRERRLLLPLSM

SEQ ID NO: 3134 - protein, 103 aa, Pennisetum glaucum
MITRAKLVEQLREHQIRSAQSYSAALAVFSPSPHIASRRDLKVALIYAVLFCFLMVSCYVALYLKWFKLSAMFVIFGILLPVSLKISRHRRLKRKRERRLLLP

SEQ ID NO: 3135 - protein, 714 aa, Secale cereale
MGAAPSTPRLGEAGAASPGAAEQMFAALVGDRAYPISSEFWRQLLELPLTQQWPRDRVLQACHAFAQNNYHTKHLAKILIHLAWCLQECTSASSVSSSVYRKAINAAYISSIFLKFIIENAKADNWQELCLDIDKDEKGLENFPSDQSVEYFLMKGVLNYIGSVDVSPESCYLHHELLNLMLVLMSTQLCSGPSPEPKDVHPFIDAAMLQDSSIVASVVQKLLLNFVRRPQIPSNGSHPVFSDDGGPGVLQRVGSAAANFVLLPYYTFNYFVSASAEGATSQLADNSLLVLLILIHYRKCISMNESIPTDGVYMSDSNTNVKDAPAFHENPYCKALNNAKDIQFDHADVEGNAQNGPVVRLSFASLFDALGTCLKDESSVLLLYSLVHGNCDFQEYVLVRTDLDTLLMPILEMLYNASRKTSNQIYMLLIILLILSQDSTFNASVHKLVLPSVPWYQERLMHQTSLGSLMVVVLIRTIKYNLSKLRDVYLHTNCLAILANMGPHAHRLSAYASQRLVSLFDMLSRKYAKLAELKNDKALKVMSDQMETDIISDDTSTELHIYTDFLRIVLEIINAILTYALPRNPEVVYAILHRQEVFQPFKNHPRFNELLENIYTVLDFFNSRMDMQQLDGEWSVDKVLELINKNCRSWRGEGMKMFTQLRFTYEQESHPEEFFIPYAWRLILSRGFSFNPGAINLFPVEIHVDDSPSSEQKV

SEQ ID NO: 3136 - protein, 714 aa, Hordeum vulgare
MGAAPSTPRLGEAGAASPGAAEQMFAALVGDRAYPISSEFWRQLLELPLTQQWPRDRVLQACHAFAQNNYHTKHLAKILIHLVWCLQECTSASSVSSSVYRKAINAAYISSIFLKFIIENAKADNWQELCLDIDKDEKGLENFPSDQSVEYFLMKGVLNYIGSVDVSPESCYLHHELLNLMLVLMSTQLCSGPSPEPKDVHPFIDAAMLQDSSIVASVVQKLLLNFVRRPQIPSNDSHPVFSDDGGPGVLQRVGSAAANFVLLPYYTFNYFVSASAEGATSQLADNSLLVLLILIHYRKCISMNESIPTDGVYMSDSTTNVKDAPAFHENPYCKAINNAKDIQFDHADVEGNAQNGPVVRLSFASLFDALGTCLKDESSVLLLYSLVHGNCDFQEYVLVRTDLDTLLMPILEMLYNASRKTSNQIYMLLIILLILSQDSTFNASVHKLVLPSVPWYQERLMHQTSLGSLMVVVLIRTIKYNLSKLRDVYLHTNCLAILANMGPHAHRLSAYASQRLVSLFDMLSRKYAKLAELKNDKALKVMSDQMEADIISDDTSTELHIYTDFLRIVLEIINAILTYALPRNPEVVYAVLHRQEVFQPFKNHPRFNELLENIYTVLDFFNSRMDMQQLDGEWSVDKVLELINKNCRSWRGEGMKMFTQLRFTYEQESHPEEFFIPYAWRLILSRGFSFNPGAINLFPVEIHVDDSPSSEQKV

SEQ ID NO: 3137 - protein, 714 aa, Oryza sativa
MGAAPSTPRLGAVAGAAASPGAAEQMFAALVGGKAYPISSEFWRQLLELPLTQQWPRDRVLQACHAFAQNNYHTKHLAKILIHLVWCLQECMAESSHAAYRKAINAAYISSIFLKFIIENAKTDNWQELSLEIDKDEKGLENFPSEQSVEYFLMRGVLNYIGSVDVSLESCYLHHELLNLMLVLMSTQLCSGPSPEPKDVHPFIDAAMLQDSSIVSSVVQKLLLNFVKRPRIPLNSSHPAFSDDGGPGVLQRVGSVAANFVLLPYYTFNYLVSSNAEGASSQLADNSLLVLLILIHYRKCITMSESFPSSNVYTSDLNTNVKDAPAFHDNPYYKALSNAKDSQYDRADVEGNAQNGLVVRLSFASLFDALGTCLKDESSVLLLYSLVHGNCDFQEYVLVRTDLDTLLMPILEMLYNASRKTSNQIYMLLIVLLILSQDSTFNASVHKLVLPSVPWYHERLMHQTSLGSLMVVILIRTIKYNLSKLRDVYLHTNCLAILANMAPHVHRLSAYASQRLVSLFDMLSRKYTKLAELKNDKAIKVISDQIEADNISDDTSTELHIYTDFLRIVLEIINAILTYALPRNPEVVYAILHRQEVFQPFKNHPRFNELLENIYTVLDFFNSRMDMQQLDGEWSVDKVLEVINKNCRSWRGEGMKMFTQLRFTYEQESHPEEFFIPYAWRVVLSRGFSFNPGAINLFPVEIHVDDEPSGEQKV

SEQ ID NO: 3138 - protein, 711 aa, Setaria italica
MGAAPSTPRLGAPPSPGAAEQMFAALVGGKAYPISSEFWNQLLELPLTLQWPRDRVLQACHAFAQNNYQTKHLAKILIHLVWCLQECTSTTSVSSVVYRRAINAAYISSIFLKFIIENAKADNWQELCLDIDKNEKGMENFPAESTVEYFLMRGVLNYIGNVDVSSESCYLHHELLNLMLVLMSTQLCSGPSPEPKDVHPFIDAAMLQDSSIVVSVVRKLLLNFVARPKFPPNGSHPVFSDDGRPGVLQRVGSAAANFVLLPYYTFTYLVSSTPEGATSQLADNSLLVLLVMIHYRKCISTNESIPSNNLYTGSDTNDKEAQVFHENPYCKALNNAKDIQYDRADVEGNAQDGPVARLSFASLFDALGRCLNDESSVLLLYSLVHGNCDFQEYVLVRTDLDTLLMPILEMLYNASRKTSNQIYMLLIILLILSQDSTFNASVHKLVLPAVPWYHERLMHQTSLGSLMVVILIRTIKYNLSKLRDVYLHTNCLAILANMAPHVHRLSAYASQRLVSLFDMLSRKYAKLAELKNDKSHKVISDQMEADNIADDMSTELHIYTDFLRIVLEIINAILTYALPRNPEVVYAVLHRQEVFEPFKNHPRFNELLENIYTVLDFFNSRMDMQQLDGEWSVDKVLEVINKNCRSWRGEGMKMFTQLRFTYEQESHPEEFFIPYAWRLVLSRGFSFNPGAINLFPVEIHLDDAPSGEEKV

SEQ ID NO: 3139 - protein, 713 aa, Panicum virgatum
MGAAPSTPRLGAAGAPPSPGAAEQMFAALVGDKAYPISSEFWKQLLELPLTLQWPRDRVLQACHAFAQNNYQTKHLAKILIHLVWCLQECTSTTSVSSVAYRRAINAAYISSIFLKFIIENAKTDNWQELCLDIDKSEKGMEKFPAEITVEYFLMRGVLNYIGSVDVSLESCYLHHELLNLMLVLMSTQLCSGPSPEPKDVHPFIDAAMLQDSSIVVSVVRKLLLNFVTRPKFPQNGSHPVFSDDGRPGVLQRVGSAAANFVLLPYYTFNYLGSSNPEGATSQLADNSLLVLLVMIHFRKCISTNESIPSNNTYMGSDTNDKEAQVFHENPYCKALNNAKDIQYDHADVEGNAQDGPVVRLSFASLFDSLGRCLNDESSVLLLYSLVHGNCDFQEYVLVRTDLDTLLMPILEMLYNASRKTSNQIYMLLIILLILSQDSTFNASVHKLVLPAVPWYHERLMHQTSLGSLMVVILIRTIKYNLSKLRDVYLHTNCLAILANMAHVHRLSAYASQRLVSLFDMLSRKYAKLAELKNDKSHKVISDQMEADNIADDMSTELHIYTDFLRIVLEIINAILTYALPRNPEVVYAVLHRQEVFEPFKDHPRFNELLENIYTVLDFFNSRMDMQQLDGEWSVDKVLEVINKNCRSWRGEGMKMFTQLRFTYEQESHPEEFFIPYAWRLVLSRGFSFNPGAINLFPVEIHLDDVPSSEQKV

SEQ ID NO: 3140 - protein, 715 aa, Zea mays
MGAAPSTPRLGAAGAAPSPSAAEQMFTALVGEKAYPISSEFWKQLLELPLTLQWPRDRVLQACHAFAENNYQTKHLAKILIHLVWCLQECTSTTSVSSVVYRRAINAAYISSIFLKFIIENAKTDSWQELCLVIDRSEKGLENFPAENTVEYFLIRGVLEYIGSVGVSPESCYLHHELLNLMLVLMSTQLCSGPSPEPKDVHPFIDAAMLQDSSIVASVVQKLLLNFVTRPKLPLNASHPVFSDDARPGVLQRVGSAAANVVLLPYYTFNYLVSSTPEGATSQLADNSLLVLLIMIHYRKCFSTNESIPTNNVYTMDSNTNDKDAPVFHDNPYCKALNSAKDIQYDRADVEGNAQNGPVVRLSFALLFDALGRFLNDEIPVLLLYSLVHGNCDFQEYVLVRTDLDTLLMPILETLYNASRKTSNQIYMLLIILLILSQDSTFNASVHKLVLPGVPWYHERLMHQTSMGSLMVVILIQTIKYNLSKLRDVYLHTNCLAILANMAPHVHRLSAYASQRLVSLFDMLSRKYAKLAELKNDKSLKVISDQMEADNIADDMSTELHIYTDFLRIVLEIINAILTYALPRNPEVVYAVLHRQEVFEPFKNHPRFNELLENIYTVLDFFNSRMDMQQLDGEWSVDKVLEVINKTCRSWRGEGMKMFTQLRFTYEQESHPEEFFIPYAWRLVLSRGFSFNPSAINLFPVEIHLEDAPAGEQKV

SEQ ID NO: 3141 - protein, 720 aa, Zea mays
MGAAPSTPTLDVAPLTPRLGAAGAPPSPSAAEQMFAALVGEKAYPISSEFWNQLLELPLTLQWPRDRVLQACHAFAENNYKTKHLAKILIHLVCCLQECTSTTSVSSVVYQRAINAAYISSIFLKFIIENAKTDSWQELCLDIDRSEKGLEKIPAENTVEYFLMRGVLDYIGSVDVSPELCYLHHELLNLMLVLMSTQLCSGPSPEPKDVHPFIDAAMLQDSSIVASVVQKLLLNFVTRPKIPLNASHPVFSDDGRPGVLQRVGSAAANFVLLPYYYLVSSTPEGATSQLADNSLLVLLIMIHYRKCISTNESIPTNNVYTMDSNTNDKDAPVFHDNPYCKALNSAKDIQYDRADVEGNAQDRPVVRLSFASLFDAFGRCLNDESSVLLLYSLVYGNCDFQEYVLVRTDLDTLLMPILEMLYNASRKTSNQIYMLLIILLILSQDSTFNASVHQLVLPAVPWYHERLMHQTSLGSLMVVILIRTIKYNLSKLKDVYLHTNCLAILANMAPHVHRLSAYASQRLVSLFDMLSRKYAKLAELKNDKSLKVIYDQMEADIADDMSIELHIYTDFLRIVLEIIIAILTYALPRNPEVVYAVLHRQEVFEPFKNHPRFSELLENIYTVLDFFNSRMDMQQLDGEWSVDKVLEVINKTCRSWRGEGMKMFTQLRFTYEQESHPEEFFIPYAWRLVLSRGFSFNPDAINLFPVEIHLEEAPAGGQKV

SEQ ID NO: 3142 - protein, 623 aa, Triticum aestivum
ASSVSSSVYRKAINAAYISSIFLKFIIENAKADNWQELCLDIDKDEKGLENIPSDQSVEYFLMKGVLNYIGSVDVSPESCYLHHELLNLMLVLMSTQLCSGPSPEPKDVHPFIDAAMLQDSSIVASVVQKLLLNFVRRPQIPSNGSHPVFSDDGGPGVLQRVGSAAANFVLLPYYTFNYFVSASAEGATSQLADNSLLVLLILIHYRKCISMNESIPTDSVYMSDSNTNVKDAPAFHENPYCKALNNAKDIQFDHADVEGNAQNGPVVRLSFASLFDALGTCLKDESSVLLLYSLVHGNCDFQEYVLVRTDLDTLLMPILEMLYNASRKTSNQIYMLLIILLILSQDSTFNASVHKLVLPSVPWYQERLMHQTSLGSLMVVVLIRTIKYNLSKLRDVYLHTNCLAILANMGPHAHRLSAYASQRLVSLFDMLSRKYAKLAELKNDKALKVTSDQMEADIISDDTSTELHIYTDFLRIVLEIINAILTYALPRNPEVVYAVLHRQEVFQPFKNHPRFNELLENIYTVLDFFNSRMDMQQLDGEWSVDKVLELINKNCRSWRGEGMKMFTQLRFTYEQESHPEEFFIPYAWRLILSRGFSFNPGAINLFPVEIHVDDSPSSEQKV

SEQ ID NO: 3143 - protein, 773 aa, Sorghum bicolor
MGAAPSTPRLGAAGAPPSPSAAEQMFAALVGEKAYPISSEFWKQLLELPLTLQWPRDRVLQACHAFGECGQGPSRSTSRLRKFRGCADCFLALSCLMMIFTPPSFECFDPWGNADHDHVLCAPAAENNYQTKHLAKILIHLVWCLQECTSTTSVSSVVYRRAINAAYMSSIFLKFIIENAKTDSWQELCLDIDRSEKGLENFPAENTLEYFLMRGVLDYIGSVDVSPESCYLHHELLNLMLVLMSTQLCSGPSPEPKDVHPFIDAAMLQDSSIVASVVQKLLLNFVTRPKIPLNASHPVFSDDGRPGVLQRVGSAAANIVLLPYYTFNYLVSSTPEGATSQLADNSLLVLLIMIHYRKCISTNESIPTNNVYTMDSNTNEKDAPVFHDNPYCKALNSAKDIQYDRADVEGNAQDGPVVRLSFALLFDALGRCLNDESSVLLLYSLVHGNCDFQEYVLVRTDLDTLLMPILEMLYNASRKTSNQIYMLLIILLILSQDSTFNASVHKLVLPAVPWYHERLMHQTSLGSLMVVILIRTIKYNLSKLRDVYLHTNCLAILANMAPHVHRLSAYASQRLVSLFDMLSRKYAKLAELKNDKSLKVISDQMEADNIADDMSTELHIYTDFLRIVLEIINAILTYALPRNPEVVYAVLHRQEVFEPFKNHPRFNELLENIYTVLDFFNSRMDMQQLDGEWSVDKVLEVINKTCRSWRGEGMKMFTQLRFTYEQESHPEEFFIPYAWRLVLSRGFSFNPGAINLFPVEIHLEDAPAGEQKV

SEQ ID NO: 3144 - protein, 607 aa, Triticum aestivum
YISSIFLKFIIENAKADNWQELCLDIDKDEKGLENFPSDQSVEYFLMKGVLNYIGSVDVSPESCYLHHELLNLMLVLMSTQLCSGPSPEPKDVHPFIDAAMLQDSSIVASVVQKLLLNFVRRPQIPSNGSHPVFSDDGGPGVLQRVGSAAANFVLLPYYTFNYFVSASAEGTTSQLADNSLLVLLILIYYRKCISMNESIPTDGVYMSDSNTNVKDAPAFHENPYCKALNNAKDIQFDHADVEGNAQNGPVVSLSFASLFDALGTCLKDESSVLLLYSLVHGNCDFQEYVLVRTDLDTLLMPILEMLYNASRKTSNQIYMLLIILLILSQDSTFNASVHKLVLPSVPWYQERLMHQTSLGSLMVVVLIRTIKYNLSKLRDVYLHTNCLAILANMGPHAHRLSAYASQRLVSLFDMLSRKYAKLAELKNDKALKVTPDQMEADIISDDTSTELHIYTDFLRIVLEIINAILTYALPRNPEVVYAVLHRQEVFQPFKNHPRFNELLENIYTVLDFFNSRMDMQQLDGEWSVDKVLELINKNCRSWRGEGMKMFTQLRFTYEQESHPEEFFIPYAWRLILSRGFSFNPGAINLFPVEIHVDDSPSSEQKV

SEQ ID NO: 3145 - protein, 243 aa, Triticum aestivum
MASPGPAPAGELLRIDPIELRFPFELKKQISCSMQLSNLSDDYIAFKVKTTSPKKYSVRPNTGVVLPRSTCDVVVTMQAQREVPSDMQCKDKFLVQSVVAPSGINVKDVTGEMFMKESGNKIEEVKLRVTYVAPPQPPSPVPEESEEGSPSRVESENGDGPAGGFTRALRERIEPQEKSLEAGALISKLTEEKNSAIQQNHKIRQELDMMRREVSKRRGGGFSFVIVIIVALIGIFLGYMMKS

SEQ ID NO: 3146 - protein, 243 aa, Pseudoroegneria spicata
MASPGPAPAGELLRIDPIELRFPFELKKQISCSMQLSNLSDDYIAFKVKTTSPKKYSVRPNTGVVLPRSTCDVVVTMQAQREVPSDMQCKDKFLVQSVIAPSGINVKDVTGEMFMKESGNKIEEVKLRVTYVAPPQPPSPVPEESEEGSPSRVESENGDGPAGGFTRALRERIEPQEKSLEAGALISKLTEEKNSAIQQNHKIRQELDMMRREVSKRRGGGFSFVIVIIVALIGIFLGYMMKS

SEQ ID NO: 3147 - protein, 243 aa, Secale cereale
MASPGPAPTGELLRIDPIELRFPFELKKQISCSMQLSNLSDDYIAFKVKTTSPKKYSVRPNTGVVLPRSTCDVVVTMQAQREVPSDMQCKDKFLVQSVVAPSGINVKDVTGEMFMKESGNKIEEVKLRVTYVAPPQPPSPVPEESEEGSPSRVESENGDGPAGGFTRALRERIEPQEKSLEAGALISKLTEEKNSAIQQNHKIRQELDMMRREVSKRRGGGFSFVIVIIVALIGIFLGYMMKS

SEQ ID NO: 3148 - protein, 243 aa, Avena sativa
MASPGPAPAGELLRIDPIELRFPFELKKQISCSLQLSNLSEDYIAFKVKTTSPKKYSVRPNTGVVLPRSTCDVVVTMQAQRESPPDMQCKDKFLVQNVIAPSGINVKDVTGEMFTKESGNKVEEVKLRVTYVAPPQPPSPVPEESEEGSPSRGESENGDGPAGGFTRALRERIEPQEKSLEAGALISKLTEEKNSAIQQNHKIRQELDMMRREVSKRRGGGFSFVIVIIVALIGIFLGYMMKS

SEQ ID NO: 3149 - protein, 243 aa, Oryza sativa
MASPGPATAGELLRIDPVELRFPFELKKQISCSMQLSNLSDDYIAFKVKTTSPKKYSVRPNTGVVLPRSTCDVVVTMQAQREAPPDMQCKDKFLVQSVIAPSGVTVKDITGEMFTKESGNKVEEVKLRVTYIAPPQPPSPVPEESEEGSPSRVSESENGDSLGGGFTRALRERIEPQENSLEAGALINKLNEEKNSAIQQNHKIRQELDMMRREISKKRGGFSFIIVIIVALIGIFLGYMMKS

SEQ ID NO: 3150 - protein, 244 aa, Panicum virgatum
MAAPAPATTGELLRIDPLELRFPFELKKQISCSMQLSNLSNDYIAFKVKTTSPKKYSVRPNTGVVLPRSTCDVVVTMQAQRETPPDMQCKDKFLVQSIVAPAGITVKDVTGEMFTKESENKMEEVKLRVTYVAPPQPPSPVPEESEEGSPSRASESENGDGPAGGFTRALRERIDPQEKSLEAGALISKLTEEKNSAIQQNHRLRQELDLVRREISKRRGGGFSFIVVIIVALIGIFLGYLMKS

SEQ ID NO: 3151 - protein, 244 aa, Panicum virgatum
MAAPAPATTGELLRIDPLELRFPFELKKQISCSMQLSNLSNDYIAFKVKTTSPKKYSVRPNTGVVLPRSTCDVVVTMQAQREAPPDMQCKDKFLVQSVVAPAGITVKDVTGDMFTKESGNKMEEVKLRVTYVAPPQPPSPVPEESEEGSPPRASESESGDGPAGGFTRAFRERIDPQEKSLEAGALISKLTEEKNSAIQQNHRLRQELDSVRREISKRRGGGFSFIVVIIVALIGIFLGYLMKS

SEQ ID NO: 3152 - protein, 244 aa, Saccharum officinarum
MATPAPATAGELLRVEPLELRFPFELKKQISCSMQLSNHTDDYIAFKVKTTSPKKYSVRPNTGVVLPRSTCDVVVTMQAQREAPPDMQCKDKFLVQSVVAPAGITVKDVTGDMFTKESGNKMEEVKLRVTYVAPPQPPSPVPEESEEGSPSRASESENGDGPAGGFTRALRERIEPQDKSTEAGALISKLTEEKNSAIQQNHRLRQELDLVRQEISKRRGGGFSFIIVIIVALIGIILGYLMKS

SEQ ID NO: 3153 - protein, 244 aa, Pennisetum glaucum
MAAPAPATAGELLRIDPLELRFPFELKKQISCSMQLSNLSGDWIAFKVKTTSPKKYSVRPNTGVVSPRSTCDVVVTMQAQREAPPDMQCKDKFLVQSIVTPAGTSVKDVTGEMFTKESGNKMEEVKLRVTYVAPPQPPSPVPEESEEGSPSRASESENGDGPAGGFTRALRERMEPQEKSSEAGSLISKLTEEKNSAIQQNQRLRQELDSVRREISKRRGGGYSFIVVIIVALIGIFLGYLMKS

SEQ ID NO: 3154 - protein, 245 aa, Setaria italica
MAASAPATAGELLRIDPLELRFPFELKKQISCSMQLSNLSNDYIAFKVKTTSPKKYSVRPNTGVVSPRSTCDVVVTMQAQRETPPDMQCKDKFLVQSIVAPAGIITMKDVTADMFTKESGNKMEEVKLRVTYVAPPQPPSPVPEESEEGSPSRASESENGDGPAGGFTRALRERMEPQEKSSEAGALISKLTEEKNSAIQQNHRLRQELDLVRREISKRRGGGFSFIVVIIVALIGIFLGYLMKS

SEQ ID NO: 3155 - protein, 244 aa, Sorghum bicolor
MATPAPATAGELLRVEPLELRFPFELNKQISCSMQLSNHTNDYIAFKVKTTSPKKYSVRPNTGVVLPRSTCDVVVTMQAQRLAPPDMQCKDKFLVQSIVAPSGITVKDVTGDMFTKESGNKMEEVKLRVTYVAPPQPPSPVPEESEEGSPSRTSESENGDGPAGGFTRALRERIEPQDKSTEAGALISKLTEEKNSAIQQNHRLRQELDLVRQEISKRRGGGFSFIIVIIVALIGIILGYLMKS

SEQ ID NO: 3156 - protein, 244 aa, Zea mays
MAAPAPATTGDLLRVDPLELRFPFELKKQISCSMQLSNHTDDYIAFKVKTTSPKKYSVRPNTGVVLPRSTCDVVVTMQAQREAPPDMQCKDKFLVQSVVAPAGITVKDVTGDMFTKESGYKMEEVKLRVTYVAPPQPPSPVPEESEEGSPPRASESENGDGPSGGFTRALRERIEPQDKSTEAGALVSKLTEEKNSAIQQNHRLRQELDLVRQEISKRRGGGFSFIVVIIVALIGAILGYLMKS

SEQ ID NO: 3157 - protein, 273 aa, Panicum virgatum
MAAPAPATTGELLRIDPLELRFPFELKKQISCSMQLSNLSNDYIAFKVKTTSPKKYSVRPNTGVVLPRSTCDVVVTMQAQREAPPDMQCKDKFLVQSVVAPAGITVKDVTGDMFTKESGNKMEEVKLRVTYVAPPQPPSPVPEESEEGSPPRASESESGDGPAGGFTRALRERIDPQEKSLEAGALISKLTEEKNSAIQQNHRLRQELVSEASHFIYLCYCIADLYHECCKFRKKKTGNLCQTIHLLMLDPFFIILSIQRKNHKIVVVAILIP

SEQ ID NO: 3158 - protein, 237 aa, Leymus cinereus x Leymus triticoides
MFLTRTEYDRGVNTFSPEGRLFQVEYAIEAIKLGSTAIGLKTKDGVVLAVEKRVTSPLLEPSSVEKIMEIDEHVGCAMSGLIADARTLVEHARVETQNHRFSYGEPMTVESTTQAICDLALRFGEGEEESMSRPFGVSLLIAGHDENGPSLYYTDPSGTFWQCNAKAIGSGSEGADSSLQEQFNKELTLQEAETIALSILKQVMEEKVTPNNVDIAKVAPNYHLYTPAEVEAVIARL

SEQ ID NO: 3159 - protein, 237 aa, Triticum aestivum
MFLTRTEYDRGVNTFSPEGRLFQVEYAIEAIKLGSTAIGLKTKDGVVLAVEKRVTSPLLEPSSVEKIMEIDEHVGCAMSGLIADARTLVEHARVETQNHRFSYGEPMTVESTTQAICDLALRFGEGEEESMSRPFGVSLLIAGHDENGPSLYYTDPSGTFWQCNAKAIGSGSEGADSSLQEQFNKELTLQEAETIALSILKQVMEEKVTPNNVDIAMVAPNYHLYTPAEVEAVIARL

SEQ ID NO: 3160 - protein, 237 aa, Triticum aestivum
MFLTRTEYDRGVNTFSPEGRLFQVEYAIEAIKLGSTAIGLKTKDGVVLAVEKRVTSPLLEPSSVEKIMEIDEHVGCAMSGLIADARTLVEHARVETQNHRFSYGEPMTVESTTQAICDLALRFGEGEEESMSRPFGVSLLIAGHDENGPSLYYTDPSGTFWQCNAKAIGSGSEGADSSLQEQFNKELTLQEAETIALSILKQVMEEKVTPNNVDIARVAPNYHLYTPAEVEAVIARL

SEQ ID NO: 3161 - protein, 237 aa, Secale cereale
MFLTRTEYDRGVNTFSPEGRLFQVEYAIEAIKLGSTAIGLKTKDGVVLAVEKRVTSPLLEPSSVEKIMEIDEHVGCAMSGLIADARTLVEHARVETQNHRFSYGEPMTVESTTQAICDLALRFGEGEEESMSRPFGVSLLIAGHDENGPSLYYTDPSGTFWQCNAKAIGSGSEGADSSLQELFNKELTLQVAETIALSILKQVMEEKVTPNNVDIAKVAPNYHLYTPAEVEAVIARL

SEQ ID NO: 3162 - protein, 237 aa, Festuca arundinacea
  misc_feature (202)..(202): Xaa can be any naturally occurring amino acid
MFLTRTEYDRGVNTFSPEGRLFQVEYAIEAIKLGSTAIGLKTKDGVVLAVEKRVTSPLLEPSSVEKIMEIDEHVGCAMSGLIADARTLVEHARVETQNHRFSYGEPMTVESTTQAICDLALRFGEGEEESMSRPFGVSLLIAGHDENGPSLYYTDPSGTFWQCNAKAIGSGSEGADSSLQEQFNKELTLEEAESIALSILKXVMEEKVTPNNVDIAKVAPNYHLYTPAEVEAVIARL

SEQ ID NO: 3163 - protein, 237 aa, Avena sativa
MFLTRTEYDRGVNTFSPEGRLFQVEYAIEAIKLGSTAIGLKTKDGVVLAVEKRVTSPLLEPSSVEKIMEIDEHVGCAMSGLIADARTLVEHARVETQNHRFSYGEPMTVESTTQAICDLALRFGEGEEESMSRPFGVSLLIAGHDENGPSLYYTDPSGTFWQCNAKAIGSGSEGADSSLQEQFNKELTLEEAENIALSILKQVMEEKVTPNNVDIAKVAPNYHLYTPAEVEAIIARL

SEQ ID NO: 3164 - protein, 237 aa, Avena sativa
MFLTRTEYDRGVNTFSPEGRLFQVEYAIEAIKLGSTAIGLKTKDGVVLAVEKRVTSPLLEPSSVEKIMEIDEHVGCAMSGLIADARTLVEHARVETQNHRFSYGEPMTVESTTQAICDLALRFGEGEEESMSRPFGVSLLIAGHDENGPSLYYTDPSGTFWQCNAKAIGSGSEGADSSLQEQYNKELTIAEAETIALSILKQVMEEKVTPNNVDIAKVSPNYHLYTPAEVEAVIARL

SEQ ID NO: 3165 - protein, 237 aa, Oryza sativa
MFLTRTEYDRGVNTFSPEGRLFQVEYAIEAIKLGSTAIGLKTKDGVVLAVEKRVTSPLLEPSSVEKIMEIDEHIGCAMSGLIADARTLVEHARVETQNHRFSYGEPMTVESTTQAICDLALRFGEGDEESMSRPFGVSLLIAGHDENGPSLYYTDPSGTFWQCNAKAIGSGSEGADSSLQEQYNKELTLQEAETIALSILKQVMEEKVTPNNVDIAKVSPNYHLYTPAEVEAVIARL

SEQ ID NO: 3166 - protein, 237 aa, Unknown
  Sequence found in Organisms: Zea mays, Sorghum bicolor, Saccharum officinarum
MFLTRTEYDRGVNTFSPEGRLFQVEYAIEAIKLGSTAIGLKTKDGVVLAVEKRVTSPLLEPSSVEKIMEIDEHIGCAMSGLIADARTLVEHARVETQNHRFSYGEPMTVESSTQAICDLALRFGEGDEESMSRPFGVSLLIAGHDENGPSLYYTDPSGTFWQCNAKAIGSGSEGADSSLQEQYNKELTLQEAETIALSILKQVMEEKVTPNNVDIAKVAPKYHLYTPAEVEAVIARL

SEQ ID NO: 3167 - protein, 237 aa, Brachypodium distachyon
MFLTRTEYDRGVNTFSPEGRLFQVEYAIEAIKLGSTAIGLKTKDGVVLAVEKRVTSPLLEPSSVEKIMEIDEHVGCAMSGLIADARTLVEHARVETQNHRFSYGEPMTVESTTQAICDLALRFGEGDEESMSRPFGVSLLIAGHDENGPSLYYTDPSGTFWQCNAKAIGSGSEGADSSLQEQYNKELTLAEAETIALSILKQVMEEKVTPNNVDIAKVSPSYHLYTPAEVEAVIARL

SEQ ID NO: 3168 - protein, 237 aa, Unknown
  Sequence found in Organisms: Cenchrus ciliaris, Setaria italica
MFLTRTEYDRGVNTFSPEGRLFQVEYAIEAIKLGSTAIGLKTKDGVVLAVEKRVTSPLLEPSSVEKIMEIDEHIGCAMSGLIADARTLVEHARVETQNHRFSYGEPMTVESSTQAICDLALRFGEGDEESMSRPFGVSLLIAGHDENGPSLYYTDPSGTFWQCNAKAIGSGSEGADSSLQEQYNKDLTLQEAETIALSILKQVMEEKVTPNNVDIAKVAPKYHLYTPAEVEAVIARL

SEQ ID NO: 3169 - protein, 237 aa, Allium cepa
MFLTRTEYDRGVNTFSPEGRLFQVEYAIEAIKLGSTAIGLKTKEGVVLAVEKRVTSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKELTLAEAETIALSILKQVMEEKVTPNNVDIAKVAPNYHLYAPAEVEAVIGRL

SEQ ID NO: 3170 - protein, 237 aa, Allium cepa
MFLTRTEYDRGVNTFSPEGRLFQVEYAIEAIKLGSTAIGLKTKEGVVLAVEKRVTSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKELTLAEAETIALSILKQVMEEKVTPNNVDIAKVAPNYHLYTPSEVEAVIGRL

SEQ ID NO: 3171 - protein, 237 aa, Sorghum bicolor
MFLTRTEYDRGVNTFSPEGRLFQVEYAIEAIKLGSTAIGLKTKDGVVLAVEKRVTSPLLEPSSVEKIMEIDEHIGCAMSGLIADARTLVEHARVETQNHRFSYGEPMTVESSTQAICDLALRFGEGDEESMSRPFGVSLLIAGHDENGPSLYYTDPSGTFWQCNAKAIGSGSEGADSSLQEQYNKELTLEEAETIALSILKQVMEEKVTPNNVDIAKVAPKYHLYTPAEVEAVIARL

SEQ ID NO: 3172 - protein, 237 aa, Panicum virgatum
MFLTRTEYDRGVNTFSPEGRLFQVEYAIEAIKLGSTAIGLRTKDGVVLAVEKRVTSPLLEPSSVEKIMEIDEHIGCAMSGLIADARTLVEHARVETQNHRFSYGEPMTVESSTQAICDLALRFGEGDEESMSRPFGVSLLIAGHDENGPSLYYTDPSGTFWQCNAKAIGSGSEGADSSLQEQYNKDLTLQEAETIALSILKQVMEEKVTPNNVDIAKVAPKYHLYTPAEVEAVIARL

SEQ ID NO: 3173 - protein, 237 aa, Euonymus alatus
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKEVTLQEAETIALSILKQVMEEKVTPNNVDIAKVAPNYHLYTPSEVEAVIGRL

SEQ ID NO: 3174 - protein, 237 aa, Festuca arundinacea
  misc_feature (227)..(227): Xaa can be any naturally occurring amino acid
MFLTRTEYDRGVNTFSPEGRLFQVEYAIEAIKLGSTAIGLKTKEGVVLAVEKRVTSPLLEPSSVEKIMEIDEHVGCAMSGLIADARTLVEHARVETQNHRFSYGEPMTVESTTQAICDLALRFGEGEEESMSRPFGVSLLIAGHDENGPSLYYTDPSGTFWQCNAKAIGSGSEGADSSLQEQYNKELTIAEAETIALSILKQVMEEKVTPNNVDIAKVSPSYHLYTXAEVEAVIARL

SEQ ID NO: 3175 - protein, 237 aa, Zea mays
MFLTRTEYDRGVNTFSPEGRLFQVEYAIEAIKLGSTAIGLKTKDGVVLAVEKRVTSPLLEPSSVEKIMEIDEHIGCAMSGLIADARTLVEHARVETQNHRFSYGEPMTVESSTQAICDLALRFGEGDEESMSRPFGVSLLIAGHDENGPSLYYTDPSGTFWQCNAKAIGSGSEGADSSLQEQYNKELALEEAETIALSILKQVMEEKVTPNNVDIAKVAPKYHLYTPAEVEAVIARL

SEQ ID NO: 3176 - protein, 237 aa, Pennisetum glaucum
MFLTRTEYDRGVNTFSPEGRLFQVEYAIEAIKLGSTAIGLKTKDGVVLAVEKRVTSPLLEPSSVEKIMEIDEHIGCAMSGLIADARTLVEHARVETQNHRFSYGEPMTIESSTQAICDLALRFGEGDEESMSRPFGVSLLIAGHDENGPSLYYTDPSGTFWQCNAKAIGSGSEGADSSLQEQYNKDLTLQEAETIALSILKQVMEEKVTPNNVDIAKVAPKYHLYTPAEVEAVIARL

SEQ ID NO: 3177 - protein, 237 aa, Pennisetum glaucum
MFLTRTEYDRGVNTFSPEGRLFQVEYAIEAIKLGSTAIGLKTKDGVVLAVEKRVTSPLLEPSSVEKIMEIDEHIGCAMSGLIADARTLGEHARVETQNHRFSYGEPMTVESSTQAICDLALRFGEGDEESMSRPFGVSLLIAGHDENGPSLYYTDPSGTFWQCNAKAIGSGSEGADSSLQEQYSKELTLQEAETIALSILKQVMEEKVTPNNVDIAKVAPKYHLYTPAEVEAVIARL

SEQ ID NO: 3178 - protein, 237 aa, Unknown
  Sequence found in Organisms: Pseudoroegneria spicata, Secale cereale
MFLTRTEYDRGVNTFSPEGRLFQVEYAIEAIKLGSTAIGLMTKDGVVLAVEKRVTSPLLEPSSVEKIMEIDEHVGCAMSGLIADARTLVEHARVETQNHRFSYGEPMTVESTTQAICDLALRFGEGDEESMSRPFGVSLLIAGHDENGPSLYYTDPSGTFWQCNAKAIGSGSEGADSSLQEQYNKELTIAEAETIALSILKQVMEEKVTPNNVDIAKVSPSYHLYTPAEVEAVIARL

SEQ ID NO: 3179 - protein, 237 aa, Unknown
  Sequence found in Organisms: Arnica chamissonis, Helianthus annuus
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNKDLTLKEAETIALSILKQVMEEKVTPNNVDIAKVAPTYHLYTPAEVEAVISRL

SEQ ID NO: 3180 - protein, 237 aa, Artemisia annua
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGEEESMSRPFGVSLLIAGHDENGPSLYYTDPSGTFWQCNGKAIGSGSEGADSSLQEQYNKDLTLKEAETIALSILKQVMEEKVTPNNVDIAKVAPTYHLYTPAEVEAVIGRL

SEQ ID NO: 3181 - protein, 237 aa, Euonymus alatus
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKELTLQEAETIALSILKQVMEEKVTPNNVDIAKVAPTYHLYTPSEVEAVISRL

SEQ ID NO: 3182 - protein, 237 aa, Vitis vinifera
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNQDLTLQEAETIALSILKQVMEEKVTPNNVDIAKVAPTYHLYTPAEVEAVISRL

SEQ ID NO: 3183 - protein, 237 aa, Glycine max
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNKDLTLQEAETIALSILKQVMEEKVTPNNVDIAKVAPTYHLYTPSEVEAVISRL

SEQ ID NO: 3184 - protein, 237 aa, Triticum aestivum
MFLTRTEYDRGVNTFSPEGRLFQVEYAIEAIKLGSTAIGLMTKDGVVLAVEKRVTSPLLEPSSVEKIMEIDEHVGCAMSGLIADARTLVEHARVETQNHRFSYGEPMTVESTTQAICDLALRFGEGDEESMSRPFGVSLLIAGHDENGPSMYYTDPSGTFWQCNAKAIGSGSEGADSSLQEQYNKELTIAEAETIALSILKQVMEEKVTPNNVDIAKVSPSYHLYTPAEVEAVIARL

SEQ ID NO: 3185 - protein, 237 aa, Triticum aestivum
MFLTRTEYDRGVNTFSPEGRLFQVEYAIEAIKLGSTAIGLMTKDGVVLAVEKRVTSPLLEPSSVEKIMEIDEHVGCAMSGLIADARTLVEHARVETQNHRFSYGEPMTVESTTQAICDLALRFGEGDEESMSRPFGVSLLIAGHDENGPSLYYTDPSGTFWQCNAKAIGSGSEGADSSLQDQYNKELTIAEAETIALSILKQVMEEKVTPNNVDIAKVSPSYHLYTPAEVEAVIARL

SEQ ID NO: 3186 - protein, 237 aa, Unknown
  Sequence found in Organisms: Phaseolus vulgaris, Vigna unguiculata
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNGKAIGSGSEGADSSLQEQFNKDLTLQEAETIALSILKQVMEEKVTPNNVDIAKVAPTYHLYTPSEVEAVISRL

SEQ ID NO: 3187 - protein, 237 aa, Amsonia hubrichtii
MFLTRTEYDRGVNTFSPEGRLFQVEYAIEAIKLGSTAIGLKTKHGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKDLTLQEAETIALSILKQVMEEKVTPNNVDIAKVAPTYHLYTPSEVEAVINRL

SEQ ID NO: 3188 - protein, 237 aa, Hordeum vulgare
MFLTRTEYDRGVNTFSPEGRLFQVEYAIEAIKLGSTAIGLMTKYGVVLAVEKRVTSPLLEPSSVEKIMEIDEHVGCAMSGLIADARTLVEHARVETQNHRFSYGEPMTVESTTQAICDLALRFGEGDEESMSRPFGVSLLIAGHDENGPSLYYTDPSGTFWQCNAKAIGSGSEGADSSLQEQYNKELTIAEAETIALSILKQVMEEKVTPNNVDIANVSPSYHLYTPAEVEAVIARL

SEQ ID NO: 3189 - protein, 237 aa, Unknown
  Sequence found in Organisms: Castanea mollissima, Quercus alba
MFLTRTEYDRGVNTFSPEGRLFQVEYAIEAIKLGSTAIGLKTKEGVVLAVEKRITSPLLEPSSVEKIMEIDEHLGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKDITLQEAETIALSILRQVMEEKVTPNNVDIAKVAPNYHLYTPAEVEAVIARL

SEQ ID NO: 3190 - protein, 237 aa, Unknown
  Sequence found in Organisms: Cichorium intybus, Taraxacum officinale, Lactuca sativa, Tragopogon dubius
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNGKAIGSGSEGADSSLQEQYNKDLTLKEAETIALSILKQVMEEKVTPNNVDIAKVAPTYHLYTPAEVEAVIGRL

SEQ ID NO: 3191 - protein, 237 aa, Coffea canephora
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTIESTTQALCDLALRFGEGDEESMSRPFGVSLLIAGHDENGPSLYYTDPSGTFWQCNAKAIGSGSEGADSSLQEQYNKDLTLQEAETIALSILKQVMEEKVTPNNVDIAKVAPTYHLYTPAEVEAVITRL

SEQ ID NO: 3192 - protein, 237 aa, Gossypium hirsutum
MFLTRTEYDRGVNTFSPEGRLFQVEYAIEAIKLGSTAIGLKTKKGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKDLTLQEAETIALSILKQVMEEKVTPNNVDIAKVAPTYHLYTPSEVEAVISRL

SEQ ID NO: 3193 - protein, 237 aa, Eschscholzia californica
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHKFSYGEPMTVESTTQALCDLALRFGEGDEESMSRPFGVSLLIAGHDENGPSLYYTDPSGTFWQCNAKAIGSGSEGADSSLQEQFNKEMTLQEAETVALSILKQVMEEKVTPNNVDIAKVAPTYHLYSPAEVEAVIGRL

SEQ ID NO: 3194 - protein, 237 aa, Euonymus alatus
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKELTLQEAETIALSILKQVMEEKVTPNNVDIAKVSPTYHLYTPSEVEAVISRL

SEQ ID NO: 3195 - protein, 237 aa, Gossypium raimondii
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKDLTLQEAETIALSILKQVMEEKVTPNNVDIAKVAPTYHLYTPSEVEAVISRL

SEQ ID NO: 3196 - protein, 237 aa, Heritiera littoralis
MFLTRTEYDRGVNTFSPEGRLFQVEYAIEAIKLGSTAIGIKTKDGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKELTLQEAETIALSILKQVMEEKVTPNNVDIARVAPTYHLYTPSEVEAVITRL

SEQ ID NO: 3197 - protein, 237 aa, Lotus japonicus
MFLTRTEYDRGVNTFSPEGRLFQVEYAIEAIKLGSTAIGLKTKEGVVLAVEKRITSPLLEPSSVEKIMEIDAHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKELTLQEAETIALSILKQVMEEKVTPNNVDIAKVSPTYHLYTPAEVEAVISRL

SEQ ID NO: 3198 - protein, 237 aa, Helianthus annuus
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNKDLSLKEAETIALSILKQVMEEKVTPNNVDIAKVAPTYHLYTPAEVEAVISRL

SEQ ID NO: 3199 - protein, 237 aa, Tabernaemontana elegans
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKDLTLQEAETIALSILKQVMEEKVTPNNVDIAKVAPTYHLYTPSEVEAVITRL

SEQ ID NO: 3200 - protein, 237 aa, Vinca minor
MFLTRTEYDRGVNTFSPEGRLFQVEYAIEAIKLGSTAIGLKTKEGVVLAVEKRITSPLLEPSSVEKIMEIDDHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKDLTLQEAETIALSILKQVMEEKVTPNNVDIAKVAPSYHLYTPAEVEAVITRL

SEQ ID NO: 3201 - protein, 237 aa, Vinca minor
MFLTRTEYDRGVNTFSPEGRLFQVEYAIEAIKLGSTAIGLKTKEGVVLAVEKRITSPLLEPSSVEKIMEIDDHIGCAMSGLIADARTLVEHARVETQNHRFSYGEPMTVESTTQALCDLALRFGEGEEESMSRPFGVSLLIAGHDENGPSLYYTDPSGTFWQCNAKAIGSGSEGADSSLQEQYNKDLTLQEAETIALSILKQVMEEKVTPNNVDIAKVAPSYHLYTPAEVEAVIASL

SEQ ID NO: 3202 - protein, 237 aa, Unknown
  Sequence found in Organisms: Prunus persica, Prunus mume
MFLTRTEYDRGVNTFSPEGRLFQVEYAIEAIKLGSTAIGLKTKEGVVLAVEKRITSPLLEPSSVEKIMEIDDHIGCAMSGLIADARTLVEHARVETQNHRFSYGEPMTVESTTQALCDLALRFGEGDEESMSRPFGVSLLIAGHDEHGPSLYYTDPSGTFWQCNAKAIGSGSEGADSSLQEQYNKELTLQEAETIALSILKQVMEEKVTPNNVDIAKVAPTYHLYTPSEVEAVISRL

SEQ ID NO: 3203 - protein, 237 aa, Ambrosia trifida
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNKDLSLKEAETIALSILKQVMEEKVTPNNVDIAKVAPTYQLYTPAEVEAVISRL

SEQ ID NO: 3204 - protein, 237 aa, Arnica chamissonis
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTIESTTQALCDLALRFGEGDEESMSRPFGVSLLIAGHDENGPSLYYTDPSGTFWQCNAKAIGSGSEGADSSLQEQYNKDLTLKEAETIALSILKQVMEEKVTPNNVDIAKVAPTYHLYTPAEVEAVISRL

SEQ ID NO: 3205 - protein, 237 aa, Musa acuminata
MFLTRTEYDRGVNTFSPEGRLFQVEYAIEAIKLGSTAIGLRTKEGVVLAVEKRVTSPLLEPSSVEKIMEIDEHIGCAMSGLIADARTLVEHARVETQNHRFSYGEPMTVESTTQALCDLALRFGEGDEESMSRPFGVSLLIAGHDEHGPSLYYTDPSGTFWQCNAKAIGSGSEGADSSLQEQYNKDLTLQEAETIALSILKQVMEEKVTPNNVDIAKVAPTYHLYTPSEVEAVIARL

SEQ ID NO: 3206 - protein, 237 aa, Theobroma cacao
MFLTRTEYDRGVNTFSPEGRLFQVEYAIEAIKLGSTAIGIKTKDGVVLAVEKRITSPLLEPSSVEKIMEIDAHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKDLTLQEAETIALSILKQVMEEKVTPNNVDIAKVAPTYHLYTPSEVEAVITRL

SEQ ID NO: 3207 - protein, 237 aa, Catharanthus roseus
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKDLTLQEAETIALSILKQVMEEKVTPNNVDIAKVSPTYHLYTPSEVEAVITRL

SEQ ID NO: 3208 - protein, 237 aa, Unknown
  Sequence found in Organisms: Gossypium hirsutum, Gossypium raimondii
MFLTRTEYDRGVNTFSPEGRLFQVEYAIEAIKLGSTAIGLKTKDGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGTSLYYTDPSGTFWQCNAKAIGSGSEGADSSLQEQYNKDLTLQEAETIALSILKQVMEEKVTPNNVDIARVAPTYHLYTPSEVEAVITRL

SEQ ID NO: 3209 - protein, 237 aa, Unknown
  Sequence found in Organisms: Gossypium hirsutum, Gossypium raimondii
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNGKAIGSGSEGADSSLQEQYNKDLTLQEAETIALSILKQVMEEKVTPNNVDIAKVAPTYHLYTPSEVEAVITRL

SEQ ID NO: 3210 - protein, 237 aa, Humulus lupulus
MFLTRTEYDRGVNTFSPEGRLFQVEYAIEAIKLGSTAIGLKTKEGVVLAVEKRITSPLLEPSSVEKIMEVDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKDLTLKEAETIALSILKQVMEEKVTPNNVDIAKVAPTYHLYTPAEVEAVITRL

SEQ ID NO: 3211 - protein, 237 aa, Unknown
  Sequence found in Organisms: Medicago truncatula, Trigonella foenum-graecum
MFLTRTEYDRGVNTFSPEGRLFQVEYAIEAIKLGSTAIGLKTKEGVVLAVEKRITSPLLEPSSVEKIMEIDDHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNKDLTLQEAETIALSILKQVMEEKVTPNNVDIARVAPAYHLYTPSEVEAVISRL

SEQ ID NO: 3212 - protein, 237 aa, Momordica charantia
MFLTRTEYDRGVNTFSPEGRLFQVEYAIEAIKLGSTAIGLKTKEGVVLAVEKRITSPLLEPSSVEKIMEIDEHIGCAMSGLIADAHTLVEHARVETQNHRFSYGEPMTVESTTQALCDLALRFGEGDEESMSRPFGVALLIAGHDEKGPSLYYTDPSGTFWQCNAKAIGSGSEGADSSLQEQYNKELTLLEAETIALSILKQVMEEKVTPNNVDIAKVAPTYHLYTPAEVEAVIGRL

SEQ ID NO: 3213 - protein, 237 aa, Unknown
  Sequence found in Organisms: Glycine max, Tropaeolum majus
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNGKAIGSGSEGADSSLQEQYNKDLTLQEAETIALSILKQVMEEKVTPNNVDIAKVAPTYHLYTPSEVEAVISRL

SEQ ID NO: 3214 - protein, 237 aa, Papaver somniferum
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHKFSYGEPMTVESTTQALCDLALRFGEGEEESMSRPFGVSLLIAGHDENGPSLYYTDPSGTFWQCNAKAIGSGSEGADSSLQEQFNKEMTLQEAETVALSILKQVMEEKVTPNNVDIAKVAPKYHLYSPSEVEAVIARL

SEQ ID NO: 3215 - protein, 237 aa, Glycine max
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNGKAIGSGSEGADSSLQEQFSKDLTLQEAETIALSILKQVMEEKVTPNNVDIAKVAPTYHLYTPSEVEAVISRL

SEQ ID NO: 3216 - protein, 237 aa, Triticum aestivum
MFLTRTEYDRGVNTFSPEGRLFQVEYAIEAIKLGSTAIGLMTKDGVVLAVEKRVTSPLLEPSSVEKIMEIDEHVGCAMSGLIADARTLVEHARVETQNHRFSYGEPMTVESTTQAICDLALRFGEGDEESMSRPFGVSLLIAGHDEHGPSLYYTDPSGTFWQCKAKAIGSGSEGADSSLQEQYNKELTIAEAETIALSILKQVMEEKVTPNNVDIAKVSPSYHLYTPSEVEAVISRL

SEQ ID NO: 3217 - protein, 170 aa, Trifolium pratense
MEIDDHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNKDLTLQEAETIALSILKQVMEEKVTPNNVDIARVAPAYHLYTPSEVEAVIGRL

SEQ ID NO: 3218 - protein, 70 aa, Tripterygium wilfordii
MFLTRTEYDRGVNTFSPEGRLFQVEYAIEAIKLGSTAIGLKTKEGVVLAVEKRITSPLLEPSSVEKIIGN

SEQ ID NO: 3219 - protein, 199 aa, Ambrosia trifida
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNKDLSLKELEQLLFPS

SEQ ID NO: 3220 - protein, 237 aa, Unknown
  Sequence found in Organisms: Arabidopsis thaliana, Arabidopsis lyrata
MFLTRTEYDRGVNTFSPEGRLFQVEYAIEAIKLGSTAIGVKTKEGVVLAVEKRITSPLLEPSSVEKIMEIDDHIGCAMSGLIADARTLVEHARVETQNHRFSYGEPMTVESTTQALCDLALRFGEGEEESMSRPFGVSLLIAGHDENGPSLYYTDPSGTFWQCNAKAIGSGSEGADSSLQEQFNKDLSLQEAETIAVSILKQVMEEKVTPNNVDIAKVAPAYHLYTPQEVEAVIARL

SEQ ID NO: 3221 - protein, 237 aa, Arabidopsis thaliana
MFLTRTEYDRGVNTFSPEGRLFQVEYAIEAIKLGSTAIGVKTKEGVVLAVEKRITSPLLEPSSVEKIMEIDDHIGCAMSGLIADARTLVEHARVETQNHRFSYGEPMTVESTTQALCDLALRFGEGEEESMSRPFGVSLLIAGHDENGPSLYYTDPSGTFWQCNAKAIGSGSEGADSSLQEQFNKDITLQEAETIAVSILKQVMEEKVTPNNVDIAKVAPAYHLYTPQEVEAVISRL

SEQ ID NO: 3222 - protein, 237 aa, Aristolochia fimbriata
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQTNAKAIGSGSEGADTSLQEQYNKELTLQEAETIALSILKQVMEEKVTPNNVDIAKVAPTYHLYSPAEVETVISRL

SEQ ID NO: 3223 - protein, 237 aa, Unknown
  Sequence found in Organisms: Centaurea maculosa, Cirsium arvense, Cynara scolymus, Carthamus tinctorius
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNGKAIGSGSEGADSSLQEQYNKDLTLKEAEIIALSILKQVMEEKVTPNNVDIAKVAPTYHLYTPAEVEAVISRL

SEQ ID NO: 3224 - protein, 237 aa, Chelidonium majus
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHKFSYGEPMTVESTTQALCDLALRFGEGDEESMSRPFGVSLLIAGHDENGPSLYYTDPSGTFWQCNAKAIGSGSEGADSSLQEQFNKEMTLQEAETVALSILKQVMEEKVTPNNVDIAKVAPTYHLYSPSEVEAVISRL

SEQ ID NO: 3225 - protein, 237 aa, Cicer arietinum
MFLTRTEYDRGVNTFSPEGRLFQVEYAIEAIKLGSTAIGLKTKEGVVLAVEKRITSPLLEPSSVEKIMEIDDHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKDLTLQEAETIALSILKQVMEEKVTPNNVDIARVAPTYHLYTPSEVEAVISRL

SEQ ID NO: 3226 - protein, 237 aa, Unknown
  Sequence found in Organisms: Citrus clementina, Citrus sinensis
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGSDENGPSLYYTDPSGTFWQCNAKAIGSGSEGADSSLQEQYNKDLTLQEAETIALSILKQVMEEKVTPNNVDIARVAPTYHLYTPSEVEAVINRL

SEQ ID NO: 3227 - protein, 237 aa, Vigna unguiculata
MFLTRTEYDRGVNTFSPEGRLFQVEYAIEAIKLGSTAIGLKTKEGVVLAVEKRITSPLLEPSSVEKIMEIDDHIGCAMSGLIADARTLVEHARVETQNHRFSYGEPMTVESTTQALCDLALRFGEGDEESMSRPFGVSLLIAGHDENGPSLYYTDPSGTFWQCNGKAIGSGSEGADSSLQEQFNKDLTLQEAETIALSILKQVMEEKVTPNNVDIARVAPTYHLYTPSEVEAVISRL

SEQ ID NO: 3228 - protein, 237 aa, Flaveria ramosissima
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKDLSLKEAETIALSILKQVMEEKVTPNNVDIARVAPTYHLYTPAEVEAVISRL

SEQ ID NO: 3229 - protein, 237 aa, Actinidia deliciosa
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKDITLQEAETIALSILKQVMEEKVTPNNVDIAKVSPTYHLYTPSEVEAVISRL

SEQ ID NO: 3230 - protein, 237 aa, Elaeis guineensis
MFLTRTEYDRGVNTFSPEGRLFQVEYAIEAIKLGSTAIGLKTKEGVVLAVEKRVTSPLLEPSSVEKIMEIDEHIGCAMSGLIADARTLVEHARVETQNHRFSYGEPMTVESTTQALCDLALRFGEGDEESMSRPFGVSLLIAGHDENGPSLYHTDPSGTFWQCNAKAIGSGSEGADSSLQEQYNKDLTLLEAETIALSILKQVMEEKVTPNNVDIAKVAPTYHLYSPSEVEAVIARL

SEQ ID NO: 3231 - protein, 237 aa, Pisum sativum
MFLTRTEYDRGVNTFSPEGRLFQVEYAIEAIKLGSTAIGLKTKEGVVLAVEKRITSPLLEPSSVEKIMEIDDHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKELSLQEAETIALSILKQVMEEKVTPNNVDIARVAPAYHLYTPSEVEAVISRL

SEQ ID NO: 3232 - protein, 237 aa, Cajanus cajan
MFLTRTEYDRGVNTFSPEGRLFQVEYAIEAIKLGSTAIGLKTKEGVVLAVEKRITSPLLEPSSVEKIMEIDAHIGCAMSGLIADARTLVEHARVETQNHRFSYGEPMTVESTTQALCDLALRFGEGDEESMSRPFGVSLLIAGHDENGPSLYYTDPSGTFWQCTAKAIGSGSEGADSSLQEQYNKDLTLQEAETIALSILKQVMEEKVTPNNVDIAKVAPTYHLYTPSEVEAVISRL

SEQ ID NO: 3233 - protein, 237 aa, Papaver somniferum
MFLTRTEYDRGVNTFSPEGRLFQVEYAIEAIKLGSTAIGLKTKEGVVLAVEKRVTSPLLEPSSVEKIMEIDEHIGCAMSGLIADAHTLVEHARVETQNHKFSYGEPMTVESTTQALCDLALRFGEGEEESMSRPFGVSLLIAGHDENGPSLYYTDPSGTFWQCNAKAIGSGSEGADSSLQEQFNKEMRLQEAETVALSILKQVMEEKVTPNNVDIAKVAPKYHLYSPSEVEAVIARL

SEQ ID NO: 3234 - protein, 237 aa, Scabiosa columbaria
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNGKAIGSGSEGADSSLQEQYNKDLTLKEAETIALSILKQVMEEKVTPNNVDIAKVAPSYHLYTPAEVEEVISRL

SEQ ID NO: 3235 - protein, 237 aa, Valeriana officinalis
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGEEESMSRPFGVSLLIAGHDENGPSLYYTDPSGTFWQCNGKAIGSGSEGADSSLQEQYNKDLTLKEAETIALSILKQVMEEKVTPNNVDIAKVAPKYHLYTPSEVEDVINRL

SEQ ID NO: 3236 - protein, 237 aa, Citrullus lanatus
MFLTRTEYDRGVNTFSPEGRLFQVEYAIEAIKLGSTAIGLKTKDGVVLAVEKRITSPLLEPSSVEKIMEIDEHIGCAMSGLIADAHTLVEHARVETQNHRFSYGEPMTVESTTQALCDLALRFGEGDEESMSRPFGVALLIAGHDEKGPSLFYTDPSGTFWQCNAKAIGSGSEGADSSLQEQYNKDLTLQEAETIALSILKQVMEEKVTPNNVDIAKVAPTYHLYTPAEVEAVISRL

SEQ ID NO: 3237 - protein, 199 aa, Antirrhinum majus
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKDLTLKEAEPLHSLF

SEQ ID NO: 3238 - protein, 170 aa, Sarracenia psittacina
MEIDEHIGCAMSGLIADARTLVEHARVETQNHRFSYGEPMTVESTTQALCDLALRFGEGDEESMSRPFGVSLLIAGYDENGPSLYYTDPSGTFWQCNAKAIGSGSEGADSSLQEQYNKDITLKEAETIALSILKQVMEEKVTPNNVDIAKVAPSYHLYTPAEVEAVISRL

SEQ ID NO: 3239 - protein, 237 aa, Phaseolus vulgaris
MFLTRTEYDRGVNTFSPEGRLFQVEYAIEAIKLGSTAIGLKTKEGVVLAVEKRITSPLLEPSSVEKIMEIDDHIGCAMSGLIADARTLVEHARVETQNHRFSYGEPMTVESTTQALCDLALRFGEGDEESMSRPFGVSLLIAGHDENGPCLYYTDPSGTFWQCNGKAIGSGSEGADSSLQEQFNKDLTLQEAETIALSILKQVMEEKVTPNNVDIARVAPTYHLYTPSEVEAVISRL

SEQ ID NO: 3240 - protein, 237 aa, Arabidopsis lyrata
MFLTRTEYDRGVNTFSPEGRLFQVEYAIEAIKLGSTAIGVKTKEGVVLAVEKRITSPLLEPSSVEKIMEIDDHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNKDITLQEAETIAVSILKQVMEEKVTPNNVDIAKVAPAYHLYTPQEVEAVISRL

SEQ ID NO: 3241 - protein, 237 aa, Fagus grandifolia
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKDITLQEAETIALSILRQVMEEKVTPNNVDIAKVAATYHLYTPSEVEAVINRL

SEQ ID NO: 3242 - protein, 237 aa, Vaccinium corymbosum
MFLTRTEYDRGVNTFSPEGRLFQVEYAIEAIKLGSTAIGLKTKEGVVLAVEKRITSPLLEPSSVEKIMEIDDHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKDITLKEAETIALSILKQVMEEKVTPNNVDIAKVAPTYHLYTPSEVEAVITRL

SEQ ID NO: 3243 - protein, 237 aa, Vaccinium corymbosum
MFLTRTEYDRGVNTFSPEGRLFQVEYAIEAIKLGSTAIGLKTKEGVVLAVEKRITSPLLEPSSVEKIMEIDDHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKDITLKEAETIALSILKQVMEEKVTPNNVDIAKVAPSYHLYTPSEVEAVISRL

SEQ ID NO: 3244 - protein, 237 aa, Cleome spinosa
MFLTRTEYDRGVNTFSPEGRLFQVEYAIEAIKLGSTAIGVKTKEGVVLAVEKRITSPLLEPSSVEKIMEIDQHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNKDLTLQEAETIAMSILKQVMEEKVTPSNVDIAKVAPGYHLYTPQEVEAVITRL

SEQ ID NO: 3245 - protein, 236 aa, Eschscholzia californica
FLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHKFSYGEPMTVESTTQALCDLALRFGEGDEESMSRPFGVSLLIAGHDENGPSLYYTDPSGTFWQCNAKAIGSGSEGADSSLQEQFNKEMTLQEAETVALSILKQVMEEKVTPNNVDIAKVSPTYHLYSPAEVEAVIARL

SEQ ID NO: 3246 - protein, 237 aa, Euphorbia peplus
MFLTRTEYDRGVNTFSPEGRLFQVEYAIEAIKLGSTAIGLKTKEGVVLAVEKRITSPLLEPSSVEKVMEIDEHIGCAMSGLIADARTLVEHARVETQNHRFSYGEPMTVESTTQALCDLALRFGEGDEESMSRPFGVSLLIAGHDEHGPSLYYTDPSGTFWQCNAKAIGSGSEGADSSLQEQYNKDITLQEAETIALSILKQVMEEKVTPNNVDIARVAPTYHLYTPAEVETVIGRL

SEQ ID NO: 3247 - protein, 237 aa, Elaeis guineensis
MFLTRTEYDRGVNTFSPEGRLFQVEYAIEAIKLGSTAIGLKTKEGVVLAVEKRVTSPLLEPSSVEKIMEIDEQIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKDLTLQEAETIALSILKQVMEEKVTPNNVDIARVAPTYHLYSPSEVESVITRL

SEQ ID NO: 3248 - protein, 237 aa, Arachis hypogaea
MFLTRTEYDRGVNTFSPEGRLFQVEYAIEAIKLGSTAIGLKTKHGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGRDENGPSLYYTDPSGTFWQCNAKAIGSGSEGADSSLQEQYNKDLTLEEAETIALSILKQVMEEKVTPNNVDIAKVSEKYHLYTPAEVEAVISRL

SEQ ID NO: 3249 - protein, 237 aa, Salvia sclarea
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPCLYYTDPSGTFWQCNAKAIGSGSEGADSSLQEQYNKELTLKEAETIALSILKQVMEEKVTPNNVDIAKVSPTYHLYSPSEVEAVINRL

SEQ ID NO: 3250 - protein, 237 aa, Sesamum indicum
MFLTRTEYDRGVNTFSPEGRLFQVEYAIEAIKLGSTAIGIKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKDLTLKEAETIALSILKQVMEEKVTPNNVDIAKVSPTYHLYTPTEVEAVITRL

SEQ ID NO: 3251 - protein, 237 aa, Eutrema parvulum
MFLTRTEYDRGVNTFSPEGRLFQVEYAIEAIKLGSTAIGVKTKEGVVLAVEKRITSPLLEPSSVEKIMEIDDHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNKDLSLQEAETIAVSILKQVMEEKVTPNNVDIAKVAPAYHLYTPQEVEAVISRL

SEQ ID NO: 3252 - protein, 237 aa, Malus domestica
MFLTRTEYDRGVNTFSPEGRLFQVEYAIEAIKLGSTAIGLKTKEGVVLAVEKRITSPLLEPSSVEKIMEIDDHIGCAMSGLIADARTLVEHARVETQNHRFSYGEPMTVESTTQALCDLALRFGEGDEESMSRPFGVSLLIAGHDEHGPSLYHTDPSGTFWQCNAKAIGSGSEGADSSLQEQYNKDLTLQEAETIALSILKQVMEEKVTPNNVDIAKVSPTYHLYTPSEVEAVIARL

SEQ ID NO: 3253 - protein, 237 aa, Brassica juncea
MFLTRTEYDRGVNTFSPEGRLFQVEYAIEAIKLGSTAIGVKTKDGVMLAVEKRITSPLLEPSSVEKIMEIDDHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNKDLSLSEAETIAVSILKQVMEEKVTPNNVDIAKVAPAYHLYTPEEVEAVISRL

SEQ ID NO: 3254 - protein, 237 aa, Brassica juncea
MFLTRTEYDRGVNTFSPEGRLFQVEYAIEAIKLGSTAIGVKTKEGVVLAVEKRITSPLLEPSSVEKIMEIDDHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNKDLSLEEAETIAVSILKQVMEEKVTPNNVDIAKVAPAYHLYTPQEVEAVISRL

SEQ ID NO: 3255 - protein, 237 aa, Unknown
  Sequence found in Organisms: Brassica napus, Brassica juncea, Brassica rapa, Raphanus sativus
MFLTRTEYDRGVNTFSPEGRLFQVEYAIEAIKLGSTAIGVKTKEGVVLAVEKRITSPLLEPSSVEKIMEIDDHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNKDLSLSEAETIAVSILKQVMEEKVTPNNVDIAKVAPAYHLYTPEEVEAVISRL

SEQ ID NO: 3256 - protein, 237 aa, Brassica juncea
MFLTRTEYDRGVNTFSPEGRLFQVEYAIEAIKLGSTAIGVKTKEGVVLAVEKRITSPLLEPSSVEKIMEIDDHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNKGLSLAEAETIAVSILKQVMEEKVTPNNVDIAKVAPAYHLYTPEEVEAVISRL

SEQ ID NO: 3257 - protein, 237 aa, Unknown
  Sequence found in Organisms: Brassica napus, Brassica rapa
MFLTRTEYDRGVNTFSPEGRLFQVEYAIEAIKLGSTAIGVKTKEGVVLAVEKRITSPLLEPSSVEKIMEIDDHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNKDLSLSEAETIAVSILKQVMEEKVTPNNVDIAKVAPAYHLYTPQEVEAVISRL

SEQ ID NO: 3258 - protein, 237 aa, Cleome spinosa
MFLTRTEYDRGVNTFSPEGRLFQVEYAIEAIKLGSTAIGVKTKEGVVLAVEKRITSPLLEPSSVEKIMEIDQHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKDLTLQEAETIAMSILKQVMEEKVTPSNVDIAKVAPEYHLYTPQEVEAVISRL

SEQ ID NO: 3259 - protein, 237 aa, Cucurbita pepo
MFLTRTEYDRGVNTFSPEGRLFQVEYAIEAIKLGSTAIGLKTKEGVVLAVEKRITSPLLEPSSVEKIMEIDEHIGCAMSGLIADAHTLVEHARVETQNHRFSYGEPMTVESTTQALCDLALRFGEGDEESMSRPFGVALLIAGHDEKGPSLFYTDPSGTFWQCNAKAIGSGSEGADSSLQEQYNKDLTLKEAETIALSILKQVMEEKVTPNNVDIAKVAPTYHLYTPAEVEAVISRL

SEQ ID NO: 3260 - protein, 237 aa, Eucalyptus grandis
MFLTRTEYDRGVNTFSPEGRLFQVEYAIEAIKLGSTAIGLKTKEGVVLAVEKRITSPLLEPSSVEKIMEIDDHIGCAMSGLIADARTLVEHARVETQNHRFSYGEPMTIESSTQAICDLALRFGEGDEETMSRPFGVSLLIAGHDENGPSLYYTDPSGTFWQCNAKAIGSGSEGADSSLQEQYNKDLTLAEAETIALSILKQVMEERVTPNNVDIAKVAPAYHLYTPAEVEAVISRL

SEQ ID NO: 3261 - protein, 236 aa, Euphorbia peplus
FLTRTEYDRGVNTFSPEGRLFQVEYAIEAIKLGSTAIGLKTKHGVVLAVEKRITSPLLEPSSVEKVMEIDEHIGCAMSGLIADARTLVEHARVETQNHRFSYGEPMTVESTTQALCDLALRFGEGDEESMSRPFGVSLLIAGHDEHGPSLYYTDPSGTFWQCNAKAIGSGSEGADSSLQEQYNKDITLQEAETIALSILKQVMEEKVTPNNVDIARVAPTYHLYTPAEVETVIGRL

SEQ ID NO: 3262 - protein, 237 aa, Fagopyrum esculentum
MFLTRTEYDRGVNTFSPEGRLFQVEYAIEAIKLGSTAIGIKTKDGVVLAVEKRITSPLLEPSSVEKIMEIDSHIGCAMSGLIADARTLVEHARVETQNHRFSFGEPMTVESTTQALCDLALRFGEGDEESMSRPFGVSLLIAGHDENGPSLYYTDPSGTFWECSAKAIGSGSEGADSSLQEQYNKELSLQEAETIALSILKQVMEEKVTPNNVDIAKVAPGYHLYTPSEVEAVISRL

SEQ ID NO: 3263 - protein, 235 aa, Flaveria ramosissima
LTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKDLSLKEAETIALSILKQVMEEKVTPNNVDIARVAPTYHLYTPAEVEAVISRL

SEQ ID NO: 3264 - protein, 237 aa, Orobanche aegyptiaca
MFLTRTEYDRGVNTFSPEGRLFQVEYAIEAIKLGSTAIGIKTKEGVVLAVEKRITSPLLEPSSVEKIMEIDSHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNKDLTLKEAETIALSILKQVMEEKVTPNNVDIAKVSPTYHLYSPSEVEAVISRL

SEQ ID NO: 3265 - protein, 237 aa, Phalaenopsis aphrodite
MFLTRTEYDRGVNTFSPEGRLFQVEYAIEAIKLGSTAIGIKTKGGVVLAVEKRVTSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCSAKAIGSGSEGADSSLQEQYNKEMTLEEAETVALSILKQVMEEKVTPNNVDIAKVAPSYHLYAPPEVEAVINRL

SEQ ID NO: 3266 - protein, 236 aa, Platanus occidentalis
FLTRTEYDRGVNTFSPEGRLFQVEYAIEAIKLGSTAIALKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKDITLQEAETIALSILKQVMEEKVTPNNVDIAKVAPTYHLYSPSEVEAVISRL

SEQ ID NO: 3267 - protein, 237 aa, Papaver somniferum
MFLTRTEYDRGVNTFSPEGRLFQVEYAIEAIKLGSTAIGIKTKEGVVLAVEKRITSPLLEPSSVEKIMEIDEHVGCAMSGLIADARTLVDHGRVETQNHRFSYGEPMTVESTTQALCDLALRFGEGEEESMSRPFGVSLLIAGHDENGPSLYYTDPSGTFWQCNAKAIGSGSEGADSSLQEQFNKDMTLLEAETAALSILKQVMEEKVTPNNVDIAKVAPKYHLYSPSEVEAVIARL

SEQ ID NO: 3268 - protein, 237 aa, Euphorbia esula
  misc_feature (107)..(107): Xaa can be any naturally occurring amino acid
MFLTRTEYDRGVNTFSPEGRLFQVEYAIEAIKLGSTAIGLKTKEGVVLAVEKRITSPLLEPSSVEKVMEIDEHIGCAMSGLIADARTLVEHARVETQNHRFSYGEPXTVESTTQALCDLALRFGEGDEESMSRPFGVSLLIAGHDEHGPSLYYTDPSGTFWQCNAKAIGSGSEGADSSLQEQYNKDITLQEAETIALSILKQVMEEKVTPNNVDIARVAPTYHLYTPAEVETVIGRL

SEQ ID NO: 3269 - protein, 237 aa, Nicotiana tabacum
MFLTRTEYDRGVNTFSPEGRLFQVEYAIEAIKLGSTAIGIKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNKDLTLKEAETIALSILKQVMEEKVTPNNVDIARVSPTYHLYSPAEVETVISRL

SEQ ID NO: 3270 - protein, 237 aa, Triphysaria pusilla
MFLTRTEYDRGVNTFSPEGRLFQVEYAIEAIKLGSTAIGIKTKEGVVLAVEKRITSPLLEPSSVEKIMEIDAHIGCAMSGLIADARTLVEHARVETQNHRFSYGEPMTVESTTQALCDLALRFGEGDEESMSRPFGVSLLIAGHDENGPSLFYTDPSGTFWQCNAKAIGSGSEGADSSLQEQFNKDLTLKEAETIALSILKQVMEEKVTPNNVDIAKVSPTYHLYSPSEVEAVIGRL

SEQ ID NO: 3271 - protein, 237 aa, Triphysaria pusilla
MFLTRTEYDRGVNTFSPEGRLFQVEYAIEAIKLGSTAIGIKTKEGVVLAVEKRITSPLLEPSSVEKIMEIDAHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNKDLTLKEAETTALSILKQVMEEKVTPNNVDIAKVSPTYHLYSPSEVEAVIGRL

SEQ ID NO: 3272 - protein, 237 aa, Olea europaea
MFLTRTEYDRGVNTFSPEGRLFQVEYAIEAIKLGSTAIGLKTKEGVVLAVEKRITSPLLEPSSVEKIMEIDDHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKDLTLKEAETIALSILKQVMEEKVTPNNVDIAKVAPTYHLYSPSEVEQVISRL

SEQ ID NO: 3273 - protein, 186 aa, Panax ginseng
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIGGHDENGPSLYYTDPSGTFWECNGKAIGSGSEGADSSLQEQYNMT

SEQ ID NO: 3274 - protein, 77 aa, Sarracenia psittacina
MFLTRTEYDRGVNTFSPEGRLFQVEYAIEAIKLGSTAIGLKTKEGLCLPLRSVSLHLSWSPAVWRKLWKLMNILDVQ

SEQ ID NO: 3275 - protein, 237 aa, Ricinus communis
MFLTRTEYDRGVNTFSPEGRLFQVEYAIEAIKLGSTAIGLKTKEGVVLAVEKRITSPLLEPSSVEKVMEIDEHIGCAMSGLIADARTLVEHARVETQNHRFSYGEPMTVESTTQALCDLALRFGEGDEDSMSRPFGVSLLIAGHDENGPSLYYTDPSGTFWQCNAKAIGSGSEGADSSLQEQYNKDITLLEAETIALSILKQVMEEKVTPNNVDIARVAKTYHLYTPAEVEAVISRL

SEQ ID NO: 3276 - protein, 237 aa, Mimulus guttatus
MFLTRTEYDRGVNTFSPEGRLFQVEYAIEAIKLGSTAIGVKTKEGVVLAVEKRITSPLLEPSSVEKIMEIDQHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKDLTLKEAETIALSILKQVMEEKVTANNVDIAKVSPNYHLYSPTEVEAVIARL

SEQ ID NO: 3277 - protein, 237 aa, Unknown
  Sequence found in Organisms: Brassica napus, Brassica oleracea, Brassica rapa, Raphanus sativus
MFLTRTEYDRGVNTFSPEGRLFQVEYAIEAIKLGSTAIGVKTKEGVVLAVEKRITSPLLEPSSVEKIMEIDDHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNKDLSLEEAETIAVSILKQVMEEKVTPNNVDIAKVAPAYHIYTPQEVEAVISRL

SEQ ID NO: 3278 - protein, 237 aa, Brassica napus
MFLTRTEYDRGVNTFSPEGRLFQVEYAIEAIKLGSTAIGVKTKEGVVLAVEKRITSPLLEPSSVEKIMEIDDHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNKDLSLSEAETIAVSILKQVMEEKVTPNNVDIAKVAPAYHIYTPQEVEAVISRL

SEQ ID NO: 3279 - protein, 237 aa, Cleome gynandra
MFLTRTEYDRGVNTFSPEGRLFQVEYAIEAIKLGSTAIGVKTKEGVVLAVEKRITSPLLEPSSVEKIMEIDQHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKDLTLQEAEIIALSILKQVMEEKVTASNVDIAKVAPEYHLYTPQEVEAVISRL

SEQ ID NO: 3280 - protein, 237 aa, Unknown
  Sequence found in Organisms: Cucumis sativus, Cucumis melo
MFLTRTEYDRGVNTFSPEGRLFQVEYAIEAIKLGSTAIGLKTKEGVVLAVEKRITSPLLEPSSVEKIMEIDEHIGCAMSGLIADAHTLVEHARVETQNHRFSYGEPMTVESTTQALCDLALRFGEGDEESMSRPFGVALLIAGHDEKGPSLFYTDPSGTFWQCNAKAIGSGSEGADSSLQEQYNKDLTLQEAETIALSILKQVMEEKVTPSNVDIAKVSPTYHLYTPAEVEAVISRL

SEQ ID NO: 3281 - protein, 237 aa, Cucurbita pepo
MFLTRTEYDRGVNTFSPEGRLFQVEYAIEAIKLGSTAIGLKTKEGVVLAVEKRITSPLLEPSSVEKIMEIDEHLGCAMSGLIADAHTLVEHARVETQNHRFSYGEAMTVESTTQALCDLALRFGEGDEESMSRPFGVALLIAGHDEKGPSLFYTDPSGTFWQCNAKAIGSGSEGADSSLQEQYNKDLTLLEAETIALSILKQVMEEKVTPNNVDIAKVAPTYHLYTPAEVEAVISRL

SEQ ID NO: 3282 - protein, 237 aa, Carpinus betulus
MFLTRTEYDRGVNTFSPEGRLFQVEYAIEAIKLGSTAIGLKTKEGVVLAVEKRITSPLLEPSSVEKIMEIDDHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKDITLKEAETIALSILRQVMEEKVTPSNVDIAKVAPSYHLYTPSEVEAVINRL

SEQ ID NO: 3283 - protein, 237 aa, Ipomoea nil
MFLTRTEYDRGVNTFSPEGRLFQVEYAIEAIKLGSTAIGIMTKEGVVLAVEKRITSPLLEPSSVEKIMEIDQHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKDLTLKEAETIALSILKQVMEEKVTPNNVDIAKVAPDYHLYTPSEVEAVLSRL

SEQ ID NO: 3284 - protein, 237 aa, Lippia dulcis
MFLTRTEYDRGVNTFSPEGRLFQVEYAIEAIKLGSTAIGIKTKEGVVIAVEKRITSPLLEPNSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNGKAIGSGSEGADSSLQEQFNKDLTLKEAETIALSILKQVMEEKVTPNNVDIAKVAPTYHLYSPSEVEAVINRL

SEQ ID NO: 3285 - protein, 233 aa, Papaver somniferum
RTEYDRGVNTFSPEGRLFQVEYAIEAIKLGSTAIGLKTKEGVVLAVEKRITSPLLEPSSVEKIMEIDEHIGCAMSGLIADARTLVEHARVETQNHKFSYGEPMTVESTTQALCDLALRFGEGEEESMSRPFGVSLLIAGHDENGPSLYYTDPSGTFWQCNAKAIGSGSEGADSSLQEQFNKEMTLQEAETAALSILKQVMEEKVTPNNVDIAKVAPKYHLYSPSEVEAVIARL

SEQ ID NO: 3286 - protein, 237 aa, Raphanus sativus
MFLTRTEYDRGVNTFSPEGRLFQVEYAIEAIKLGSTAIGVKTKEGVVLAVEKRITSPLLEPSSVEKIMEIDDHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFSKDLSLSEAETIAVSILKQVMEEKVTPNNVDIAKVAPAYHLYTPEEVEAVISRL

SEQ ID NO: 3287 - protein, 237 aa, Raphanus sativus
MFLTRTEYDRGVNTFSPEGRLFQVEYAIEAIKLGSTAIGVKTKEGVVLAVEKRITSPLLEPSSVEKIMEIDDHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSFLQEQFNKDLSLSEAETIAVSILKQVMEEKVTPNNVDIAKVAPAYHLYTPEEVEAVISRL

SEQ ID NO: 3288 - protein, 237 aa, Unknown
  Sequence found in Organisms: Solanum lycopersicum, Solanum phureja
MFLTRTEYDRGVNTFSPEGRLFQVEYAIEAIKLGSTAIGIKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNKDLTLKEAETIALSILKQVMEEKVTPNNVDIARVSPTYHLYSPSEVEDVISRL

SEQ ID NO: 3289 - protein, 237 aa, Solanum lycopersicum
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKDLTLKEAETIALSILKQVMEEKVTPNNVDIARVSPTYHLYSPSEVEEVISRL

SEQ ID NO: 3290 - protein, 237 aa, Populus trichocarpa
MFLTRTEYDRGVNTFSPEGRLFQVEYAIEAIKLGSTAIGLKTKEGVVLAVEKRITSPLLEPSSVEKVMEIDECIGCAMSGLIADARTLVEHARVETQNHRFSYGEPMTVESTTQALCDLALRFGEGDEESMSRPFGVSLLIAGHDEKGPSLYYTDPSGTFWQCNAKAIGSGSEGADSTLQEQYNKDLTLKEAETIALSILKQVMEEKVTPNNVDIAKVAPVYHLYTPAEVEEVISRL

SEQ ID NO: 3291 - protein, 170 aa, Manihot esculenta
MEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKDLTLQEAETIALSILKQVMEEKVTPNNVDIAKVAPTYHLYTPAEVETVISRL

SEQ ID NO: 3292 - protein, 73 aa, Fagopyrum esculentum
MFLTRTEYDRGVNTFSPEGRLFQVEYAIEAIKLGSTAIGIKTKDGVVLAVEKRITSPLLEPSSVEKSWKLIRT

SEQ ID NO: 3293 - protein, 170 aa, Fraxinus spp
MEIDDHIGCAMSGLIADARTLVEHARVETQNHRFSYGEPMTVESTTQALCDLALRFGEGDEESMSRPFGVSLLIAGHDENGPSLYYTDPSGTFWQCTAKAIGSGSEGADSSLQEQFNKDLTLKEAETIALSILKQVMEEKVTPNNVDIAKVAPTYHLYSPSEVEEVISRL

SEQ ID NO: 3294 - protein, 211 aa, Platanus occidentalis
MPSRPSSWVNRNWVKTKEGVVLAVEKRITSPLLEPSSVEKIMEIDDHIGCAMSGLIADARTLVEHARVETQNHRFSYGEAMTVESTTQALCDLALRFGEGDEDSMSRPFGVSLLIAGHDENGPSLYYTDPSGTFWQCNAKAIGSGSEGADSSLQEQYNKEITLQEAETIALSILKQVMEEKVTPNNVDIAKVAPTYHLYSPSEVEAVISRL

SEQ ID NO: 3295 - protein, 237 aa, Mimulus guttatus
MFLTRTEYDRGVNTFSPEGRLFQVEYAIEAIKLGSTAIGVKTKEGVVLAVEKRITSPLLEPSSVEKIMEIDQHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKDLTISEAETIALSILKQVMEEKVTPNNVDIAKVSPTYHLYSPSEVEAVIARL

SEQ ID NO: 3296 - protein, 237 aa, Nicotiana benthamiana
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQHNKDLTLKEAETIALSILKQVMEEKVTPDNVDIARVSPTYHLYSPSEVEEVISRL

SEQ ID NO: 3297 - protein, 237 aa, Nicotiana benthamiana
MFLTRTEYDRGVNTFSPEGRLFQVEYAIEAIKLGSTAIGIKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNKDLSLKEAETIALSILKQVMEEKVTPNNVDIARVSPTYHLYSPSEVETVISRL

SEQ ID NO: 3298 - protein, 237 aa, Fraxinus spp
MFLTRTEYDRGVNTFSPEGRLFQVEYAIEAIKLGSTAIAIKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPCLYYTDPSGTFWQCNAKAIGSGSEGADSSLQEQYNKDLNLKEAETIALSILKQVMEEKVTPNNVDIASVAPRYHLYTPSEVEAVINRL

SEQ ID NO: 3299 - protein, 237 aa, Zingiber officinale
MFLTRTEYDRGVNTFSPEGRLFQVEYAIEAIKLGSTAIGLRTKEGVVLAVEKRVTSPLLEPSSVEKIMEIDEHIGCAMSGLIADARTLVEHGRVETQNHRFSYGEAMTVESATQALCDLALQFGEGDEESMSRPFGVSLLIAGYDENGPSLYYTDPSGTFWQCNAKAIGSGSEGADSSLQEQYNKDLTLQEAETIALSILKQVMEEKVTPNNVDIAKVAPTYHLYTPDEVKAVITRL

SEQ ID NO: 3300 - protein, 237 aa, Jatropha curcas
MFLTRTEYDRGVNTFSPEGRLFQVEYAIEAIKLGSTAIGIKTKEGVVLAVEKRITSPLLEPSSVEKVMEIDEHIGCAMSGLIADARTLVEHARVETQNHRFSYGEPMTVESTTQALCDLALRFGEGDEESMSRPFGVSLLIAGHDENGPSLYYTDPSGTLWQCNAKAIGSGSEGADSSLQEQYNKDITLLEAETIALSILKQVMEEKVTPDNVDIAKVAPTYHLYTPAEVEVVINRL

SEQ ID NO: 3301 - protein, 237 aa, Orobanche aegyptiaca
MFLTRTEYDRGVNTFSPEGRLFQVEYAIEAIKLGSTAIGIKTKEGVVLAVEKRITSPLLEPSSVEKIMEIDDHIGCAMSGLIADARTMVEHARVETQNHRFSYGEPMTVESTTQALCDLALRFGEGDEESMSRPFGVSLLIAGHDENGPSLYYTDPSGTFWQCNAKAIGSGSEGADSSLQEQFNKDLTLKEAETIALSILKQVMEEKVTANNVDIAKVSPSYHLYSPSEVEAVISRL

SEQ ID NO: 3302 - protein, 237 aa, Capsicum annuum
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPCLYYTDPSGTFWQCNAKAIGSGSEGADSSLQEQYNKDLTLKEAETIALSILKQVMEEKVTPNNVDIARVSPTYHLYLPSEVEEVISRL

SEQ ID NO: 3303 - protein, 237 aa, Lippia dulcis
MFLTRTEYDRGVNTFSPEGRLFQVEYAIEAIKLGSTAIALKTKEGVVLAVEKRITSPLLEPSSVEKIMEIDSHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNQDLTLKEAETIALSILKQVMEEKVTPNNVDIAKVSPTYHLYSPSEVEEVISRL

SEQ ID NO: 3304 - protein, 237 aa, Populus trichocarpa
MFLTRTEYDRGVSTFSPEGRLFQVEYAIEAIKLGSTAIGLKTKEGVVLAVEKRITSPLLEPSSVEKVMEIDECIGCAMSGLIADARTLVEHARVETQNHRFSYGEPMTVESTTQALCDLALRFGEGDEESMSRPFGVSLLIAGHDEKGPSLYYTDPSGTFWQCNAKAIGSGSEGADSTLQEQYNKDLTLKEAETIALSILKQVMEEKVTPNNVDIAKVAPVYHLYTPAEVEEVISRL

SEQ ID NO: 3305 - protein, 237 aa, Populus trichocarpa
MFLTRTEYDRGVNTFSPEGRLFQVEYAIEAIKLGSTAIGLKTKEGVVLAVEKRITSPLLEPSSVEKVMEIDDHIGCAMSGLIADARTLVEHARVETQNHRFSYGEPMTVESTTQALCDLALRFGEGDEESMSRPFGVSLLIAGHDEHGPSLYYTDPSGTFWQCNAKAIGSGSEGADSTLQEQYNKDLTLKEAEAIALSILKQVMEEKVTPNNVDIAKVAPTYHLYTPAEVEEVISRL

SEQ ID NO: 3306 - protein, 237 aa, Rosa hybrid cultivar
MFLTRTEYDRGVNTFSPEGRLFQVEYAIEAIKLGSTAIGLKTKEGVVLAVEKRITSPLLEPSSVEKIMEIDDHIGCAMSGLIADARTLVEHARVETQNHRFSYGEPMTVESTTQALCDLALRFGEGDEESMSRPFGVSLLIAGHDEHGPSLYYTDPSGTFWQCNAKAIGSGSEGADSSLQEQYSKDLTLKEAETIALSILKQVMEEKVTPNNVDIAKVSPTYHLYTPSEVEEVISRL

SEQ ID NO: 3307 - protein, 237 aa, Salvia sclarea
MFLTRTEYDRGVNTFSPEGRLFQVEYAIEAIKLGSTAIGVKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPCLYYTDPSGTFWQCNAKAIGSGSEGADSSLQEQYNKELTLSEAETIALSILKQVMEEKVTANNVDIAKVSPKYHLYSPSEVEEVISRL

SEQ ID NO: 3308 - protein, 237 aa, Fragaria vesca
MFLTRTEYDRGVNTFSPEGRLFQVEYAIEAIKLGSTAIGLKTKEGVVLAVEKRITSPLLEPSSVEKIMEIDAHIGCAMSGLIADARTLVEHARVETQNHRFSYGEPMTVESTTQALCDLALRFGEGDEESMSRPFGVSLLIAGHDEHGPSLYYTDPSGTFWQCNAKAIGSGSEGADSSLQEQYSKDLTLKEAETIALSILKQVMEEKVTPNNVDIAKVSPTYHLYTPSEVEEVISRL

SEQ ID NO: 3309 - protein, 237 aa, Nicotiana tabacum
MFLTRTEYDRGVNTFSPEGRLFQVEYAIEAIKLGSTAIGLKTKEGVVLAVEKRITSPLLEPSSVEKIMEIDEHVGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKDLTLKEAETIALCILKQVMEEKVTPNNVDIARISPTYHLYSPSEVEEVISRL

SEQ ID NO: 3310 - protein, 170 aa, Eutrema halophilum
MEIDDHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNKDLSLQEAETIAVSILKQVMEEKVTPNNVDIAKVAPAYHLYTPQEVEAVISRL

SEQ ID NO: 3311 - protein, 237 aa, Nicotiana benthamiana
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPNLYYTDPSGTFWQCNAKAIGSGSEGADSSLQEQYNKDLTLKEAEAIALSILKQVMEEKVTPNNVDIARVSPTYHLYSPSEVEDVISRL

SEQ ID NO: 3312 - protein, 237 aa, Zostera marina
MFLTRTEYDRGVNTFSPEGRLFQVEYAIEAIKLGSTAIGLKTKDGIVLAVEKRITSPLLEPSSVEKIMEIDEHIGCAMSGLIADARTLVEHARVETQNHRFSYGEPMAVESTTQALCDLALRFGEGDEESMSRPFGVSLLIAGHDENGPSLYYTDPSGTFWQCNAKAIGSGSEGADSSLQEEYNKEISLAEAETIALSILKQVMEEKVTPSNVDIAKVAPTFHLYSPSEVEAVINRL

SEQ ID NO: 3313 - protein, 237 aa, Solanum melongena
MFLTRTEYDRGVNTFSPEGRLFQVEYANEAIKLGSTAIGIKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNKDLSLKEAETIALSILKQVMEEKVTPNNVDIARVSPTYHLYPPSEVEDVISRL

SEQ ID NO: 3314 - protein, 237 aa, Nuphar advena
MFLTRTEYDRGVNTFSPEGRLFQVEYAIEAIKLGSTAIGIKTKEGVVLAVEKRITSPLLEPSSVEKIMEIDEHIGCAMSGLIADARTLVEHARVETQNHRFSYGEQMTVESTTQALCDLALRFGEGDEESMSRPFGVSLLIAGHDENGPSLYYTDPSGTFWQCNAKAIGSGSEGADSSLQEQYNKDISLLEAEKIALSILKQVMEEKVTPNNVDIAKVAPTYHLYSPSEVEAVISRL

SEQ ID NO: 3315 - protein, 228 aa, Parthenium argentatum
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNKDLTLKEAETIALSILKQVMEEKVTPNNVDIAKVAPTYHLYTPA

SEQ ID NO: 3316 - protein, 237 aa, Phalaenopsis aphrodite
MFLTRTEYDRGVNTFSPEGRLFQVEYAIEAIKLGSTAIGIKTKEGVVLAVEKRVTSPLLEPSSVEKIMEIDEHIGCAMSGLIADARTLVEHARVETQNHRFSYGEAMSVESTTQALCDLALRFGEGDEESMSRPFGVSLLIAGHDEHGPSLFYTDPSGTFWQCSAKAIGSGSEGADSSLQEQYNKDLSLQEAETIALSILKQVMEEKVTPNNVDIAKVAPTYHLYSPSEVEAVISRL

SEQ ID NO: 3317 - protein, 242 aa, Musa acuminata
FSLSGFLNRRTEYDRGVNTFSPEGRLFQVEYAIEAIKLGSTAIGLRTKEGVVLAVEKRVTSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKDLTLQEAETIALSILKQVMEEKVTPNNVDIAKVSPTYHLYTPSEVEAVIARL

SEQ ID NO: 3318 - protein, 124 aa, Secale cereale
MFLTRTEYDRGVNTFSPEGRLFQVEYAIEAIKLGSTAIGLMTKDGVVLAVEKRVTSPLLEPSSVEKIMEIDEHVGCAMSGLIADARTLVEHARVETQNHRFSYGEPMTVESTTQAICDLALRLW

SEQ ID NO: 3319 - protein, 237 aa, Olea europaea
MFLTRTEYDRGVNTFSPEGRLFQVEYAIEAIKLGSTAIAVKTKEGVILAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPCLYYTDPSGTFWQCNAKAIGSGSEGADSSLQEQYNKDLTLKEAETIALSILKQVMEEKVTPNNVDIASVAPRYHLYTPSDVETVINRL

SEQ ID NO: 3320 - protein, 237 aa, Olea europaea
MFLTRTEYDRGVNTFSPEGRLFQVEYAIEAIKLGSTAIAIKTEEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPCLYHTDPSGTFWQCNAKAIGSGSEGADSSLQEQYNKDLTLKEAETIALSILKQVMEEKVTPNNVDIASVAPRYHLYTPSEVETVINRL

SEQ ID NO: 3321 - protein, 237 aa, Amorphophallus konjac
MFLTRTEYDRGVNTFSPEGRLFQVEYAIEAIKLGSTAIGIKTKEGVVLGVEKRITSPLLEPSSVEKIMEIDEHIGCAMSGLIADARTLVEHARVETQNHRFSYGEAMTVESTTQALCDLALRFGEGDEESMSRPFGVSLLIAGHDENGPSLYYTDPSGTFWQCNAKAIGSGSEGADSSLQEQYNKGITLQEAETTALSILKQVMEEKVTPDNVDIAKVAPTFHLYSPSEVEAVINRL

SEQ ID NO: 3322 - protein, 237 aa, Antirrhinum majus
  misc_feature (45)..(45): Xaa can be any naturally occurring amino acid
  misc_feature (64)..(64): Xaa can be any naturally occurring amino acid
  misc_feature (91)..(91): Xaa can be any naturally occurring amino acid
MFLTRTEYDRGVNTFSPEGRLFQVEYAIEAIKLGSTAIGLKTKEXVVLAVEKRITSPLLEPSSXEKIMEIDDHIGCAMSGLIADARTLVEXARVETQNHRFSYGEPMTVESTTQALCDLALRFGEGDEESMSRPFGVSLLIAGHDENGPSLYYTDPSGTFWQCNAKAIGSGSEGADSSLQEQYNKDLTLKEAETIALSILKQVMEEKVTPNNVNIAKVSPTYHLYSPSEVEAVISRL

SEQ ID NO: 3323 - protein, 237 aa, Silene vulgaris
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCSAKAIGSGSEGADSSLQEQYRNDLTFQEAETIALSILKQVMEEKVTPNNVDIARVSPTYHLYSPSEVESVINRL

SEQ ID NO: 3324 - protein, 237 aa, Cycas rumphii
MFLTRTEYDRGVNTFSPEGRLFQVEYAIEAIKLGSTAVGLKTKQGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCDAKAIGSGSEGADSSLQEHYNKDMTLEEAETLALSILKQVMEEKVTASNVDIAKVAPKYHLYIPAEVETVISRL

SEQ ID NO: 3325 - protein, 237 aa, Nicotiana tabacum
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPNLYYTDPSGTFWQCNAKAIGSGSEGADSTLQEQYNKDLTLKEAEAIALSILKQVMEEKVTPNNVDIARVSPTYHLYSPSEVEDVISCL

SEQ ID NO: 3326 - protein, 163 aa, Euphorbia peplus
RTEYDRGVNTFSPEGRLFQVEYAIEAIKLGSTAIGLKTKEGVVLAVEKRITSPLMEPSSVEKVMEIDEHIGCAMSGLIADARTLVEHARVETQNHRFSYGEPMTVESTTQALCDLALRFGEGDEESMSRPFGVSLLIAGHDEHGPSLYYTDPSGTFWQCNAKA

SEQ ID NO: 3327 - protein, 237 aa, Zamia vazquezii
  misc_feature (200)..(200): Xaa can be any naturally occurring amino acid
MFLTRTEYDRGVNTFSPEGRLFQVEYAIEAIKLGSTAVGLKTKQGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCDAKAIGSGSEGADSSLQEHYSKDMTLEEAETTALSIXKQVMEEKVTASNVDIAKVAPTYHLYTPAEVETVISRL

SEQ ID NO: 3328 - protein, 186 aa, Eragrostis curvula
MFLTRTEYDRGVNTFSPEGRLFQVEYAIEAIKLGSTAIGLKTKDGVVLAVEKRVTSPLLEPSSVEKIMEIDEHLGCAMSGLIADARTLVEHARVETQNHRFSYGEPMTVESATQAICDLALRFGEGDEESMSRTFGVSLLIAGHDENGPSLYYSETSGKYRKCKEKEMDLALKELLGHSRNSTTRN

SEQ ID NO: 3329 - protein, 226 aa, Tripterygium wilfordii
VNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNGKAIGSGSEGADSSLQEQYNKELTLQEAETIALSILKQVMEEKVTPNNVDIAKVAPTYHLYTPSEVEAVISRL

SEQ ID NO: 3330 - protein, 226 aa, Vinca minor
MFLTRTEYDRGVNTFSPEGRLFQVEYAIEAIKLGSTAIGLKTKQGVVLAVEKRITSPLLEPSSVEKIMEIDDHIGCAMSGLIADARTLVEHARVETQNHRFSYGEPMTVDSTTQALCDLALRFGEGDEESMSRPFGVSLLIAGHDENGPSLYYTDPSGTFWQCNAKAIGSGSEGADSSLQEQYNKDLTLQEAETIALSILKQVMEEKVTPNNVDIAKVAPSYHLYT

SEQ ID NO: 3331 - protein, 233 aa, Musa acuminata
MFLTRTEYYRGVNTFSPEGRLFQVEYAIEAIKLGSTAIGLRTNEGVVLAVEKRVTSPLLEPSSVEKIMEIDEHIGCAMSGLIADARTLVEYARNHRFSYGEPMTVESTTQALCDLALRFGEGDEESMSQPFGVSLLIAGHDENGPSLYYTDPSGTFWQCSAKAIGSGSEGADSSLQEQYNKDLTLQEAETIALSISKQVMEEKVTPNNLDIARVAPTYHLYTPTEVEAVIARL

SEQ ID NO: 3332 - protein, 262 aa, Citrus clementina
MFFTRTEYDRGVNTFSPEGRLFQVEYAIEAIKLGSTAIGLKTKKRITSPLLEPSSVEKIKEIDEHIGCAMSGLIADARTLVEHARVETQNHRFSYGEPMTVESTTQALCDLVLRFGEGDEESMSRPFGVSLLIAGSDENGPSLYYTDPSGTFWQCNAKAIGSGSEGADSSLQEQYNKDLTLQEAETIALSILKQVMEEKVTPNNVDIARVAPTYHLYTPSEVEAVINRPMSIRRKSSLKILPWLQRCFFSSLQCKCTSLFVC

SEQ ID NO: 3333 - protein, 262 aa, Citrus sinensis
MFFTRTEYDRGVNTFSPEGRLFQVEYAIEAIKLGSTAIGLKTKKRITSPLLEPSSVEKIKEIDEHIGCAMSGLIADARTLVEHARVETQNHRFSYGEPMTVESTTQALCDLVLRFGEGDEESMSRPFGVSLLIAGSDENGPSLYYTDPSGTFWQCNAKAIGSGSEGADSSLQEQYNKDLTLQEAETIALSILKQVMEEKVTPNNVDIARVAPTYHLYTPSEVEAVINRPMSIRRKSSLKILPWLQRCFFSSLHCKCTSLFVC

SEQ ID NO: 3334 - protein, 242 aa, Nicotiana benthamiana
LFSFCYFFSRTEYDRGVNTFSPEGRLFQVEYAIEAIKLGSTAIGIKTKEGVVLAVEKRITSPLLEPSSVEKIMEIDEHIGCAMSGLIADARTLVEHARVETQNHRFSYGEPMTVESTTQGLCDLALRFGEGDEESMSRPFGVSLLIAGHDENGPSLYYTDPSGTFWQCNAKAIGSGSEGADSSLQEQFNKDLTLKEAETIALSILKQVMEEKVTPNNVDIARVSPTYHLYSPSEVETVISRL

SEQ ID NO: 3335 - protein, 249 aa, Aquilegia formosa
MFLTRTEYDRGVNTFSPEGRLFQVEYAIEAIKLGSTAIGLKTKHGVVLAVEKRITSPLLEPSSVEKVMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKDITLQEAETIALSILKQVMEEKASYHIRLSQRLIVTPNNVDIAKVAPTYHLYSPSEVEAVIARL

SEQ ID NO: 3336 - protein, 246 aa, Olea europaea
MFLTRTEYDRGVNTFSPEGRLFQVEYAIEAIKLGSTAIGLKTKEGVVLAVEKRITSPLLEPSSVEKIMEIDDHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKDLTLKEAETIALSILKQVMEEKVTPNNVDFAKVAPTYHLYSPSEVEQGISRLKKKAINLLC

SEQ ID NO: 3337 - protein, 245 aa, Petunia hybrida
MFLTRTEYDRGVNTFSPEGRLFQVEYAIEAIKLGSTAIGIKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSTLQEQFNKDLSLKEAETIALSILKQVMEEKVTPNNVDIARVSPTYHLYSPSEVEDVISRLYEESLFFA

SEQ ID NO: 3338 - protein, 219 aa, Guizotia abyssinica
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNKDLTLKEAETIALSILKQVMEEKVTPNNVDIAKVA

SEQ ID NO: 3339 - protein, 221 aa, Parthenium argentatum
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNKDLSLKEAETIALSILKQVMEEKVTPNNVDIAKVAPT

SEQ ID NO: 3340 - protein, 250 aa, Liriodendron tulipifera
  misc_feature (12)..(12): Xaa can be any naturally occurring amino acid
  misc_feature (40)..(40): Xaa can be any naturally occurring amino acid
  misc_feature (166)..(166): Xaa can be any naturally occurring amino acid
SKYGSRAAGIGXLQLQAFRPISRCFLPGPSTIEASTPSLXEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAXHDENGPSLYYTDPSGTFWQCNAKAIGSGSEGADSSLQEQYNKDITLQEAETIALSILKQAMQETVTPNNVDIVKVVPTYHLYSP

SEQ ID NO: 3341 - protein, 222 aa, Secale cereale
PHEVRIDPSQPKIFNAPTRCWIPRPRCCPCCEIFILFRDKFCYGVVSRRTEYDRGVNTFSPEGRLFQVEYAIEAIKLGSTAIGLKTKDGVVLAVEKRVTSPLLEPSSVEKIMEIDEHVGCAMSGLIADARTLVEHARVETQNHRFSYGEPMTVESTTQAICDLALRFGEGEEESMSRPFGVSLLIAGHDENGPSLYYTDPSGTFWQCNAKAQRRGRVKSGLL

SEQ ID NO: 3342 - protein, 237 aa, Ceratodon purpureus
MFLTRSEYDRGVNTFSPEGRLFQVEYAIEAIKLGSTAVGLKTKEGVVLAVEKRITSVLLEPTSVEKIMEIDEHIGCAMSGLTADARTLVEHGRVETQNHRFSYNEPMTVESTTQALCDLALRFGEGDEESMSRPFGVSLLIAGHDETGPCLYHTDPSGTFWQCDAKAIGSGSEGADTSLQEHFNKNMTLEEAETLALSTLKQVMEEKVTSSNVDIAKVAPKYHLYTPEEVEAVIQRL

SEQ ID NO: 3343 - protein, 170 aa, Nicotiana benthamiana
MAIDEHIGCAMSGLIADARTLVEHARVETQNHRFSYGEPMTVESTTQALCDLALRFGEGDEESMSRPFGVSLLIAGHDENGPSLYYADPSGTFWQCNAKAIGSGSEAADSSLQEQYNKDLTLKEPETIALSILEQVMEEKVTPNNVDIARVSSTYNLYSPSEVEEVISRL

SEQ ID NO: 3344 - protein, 210 aa, Ambrosia trifida
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNKDLSLKEARNNCSFHLEASDGRKGNS

SEQ ID NO: 3345 - protein, 151 aa, Fraxinus spp
MPVLWLNMHELKTQNHRFSYGEPMTVESTTQALCGLALRFGEGDEESMSRPFGVSLLIAGHDENGPSLYYTDPSGTFWQCNAKAIGSGSEGADSSLQEQYNKDLTLKEAETIALSILKQVMEEKVTPNNVDIAKVAPTTICTRLLRLKRLS

SEQ ID NO: 3346 - protein, 237 aa, Physcomitrella patens
MFLTRSEYDRGVNTFSPEGRLFQVEYAIEAIKLGSTAVGLKTKEGVVLAVEKRITSVLLEPTSVEKIMEIDEHIGCAMSGLTADARTLVEHGRVETQNHRFSYNEPMSVESTTQALCDLALRFGEGDEESMSRPFGVSLLIAGHDESGPCLYHTDPSGTFWQCDAKAIGSGSEGADTSLQEHFNKNMTLEEAETLALSTLKQVMEEKVTSSNVDIAKVAPKYHLYSPEEVEAVIQRL

SEQ ID NO: 3347 - protein, 237 aa, Physcomitrella patens
MFLTRSEYDRGVNTFSPEGRLFQVEYAIEAIKLGSTAVGLKTKEGVVLAVEKRITSVLLEPTSVEKIMEIDEHIGCAMSGLTADARTLVEHGRVETQNHRFSYNEPMSVESTTQALCDLALRFGEGDEESMSRPFGVSLLIAGHDESGPCLYHTDPSGTFWQCDAKAIGSGSEGADTSLQEHFNKNMTLEEAETLALSTLKQVMEEKVTSCNVDIAKVAPKYHLYTPEEVEVVIQRL

SEQ ID NO: 3348 - protein, 237 aa, Selaginella moellendorffii
MFLTRSEYDRGVNTFSPEGRLFQVEYAIEAIKLGSTAVGLKTNHGVVLAVEKRITSPLLEPASVEKIMEIDTHIGCAMSGLIADARTLVEHARNETQHHRFSYNEPMSVESTTQALCDLALRFGEGDEESMSRPFGVSLLIAGHDEKGPCLYHTDPSGTFWQCDAKAIGSGSEGADTSLQESYNKEMTLEEAETLALSTLKQVMEEKVTASNVDIAKVAPVFHLYTPAEVEVVIGRL

SEQ ID NO: 3349 - protein, 237 aa, Unknown
  Sequence found in Organisms: Cephalotaxus harringtonia, Taxus baccata
MFLTRSEYDRGVNTFSPEGRLFQVEYAMEAIKLGSTAVGLKTTHGVILAVEKRITSPLLEPSSVEKIMEIDEHIGCAMSGLIADARTLVEHARVETQNHRFSYGEPMSAESTTQALCDLALRFGEGDEDSMSRPFGVSLLIAGHDENGPCLYYTDPSGTFWQSDAKSIGSGVEAADISLKEQYRKDMTLEEAETAALSILKQVMEDKVTANNVDIAKVAPTYHLYTPAEVEAVISRL

SEQ ID NO: 3350 - protein, 237 aa, Cryptomeria japonica
MFLTRSEYDRGVNTFSPEGRLFQVEYAMEAIKLGSTAVGLKTNHGVILAVEKRITSPLLEPSSVEKIMEIDEHIGCAMSGLIADARTLVEHARVETQNHRFSYGEPMSAESTTQALCDLALRFGEGDEDSMSRPFGVSLLIAGHDENGPCLYYTDPSGTFWQSDAKSIGSGVEAADISLKEQYSKDMTLEEAETAALSILKQVMEDKVTANNVDIAKVAPTYHLYTPAEVEAVISRL

SEQ ID NO: 3351 - protein, 237 aa, Unknown
  Sequence found in Organisms: Pinus pinaster, Pinus taeda
MFLTRSEYDRGVNTFSPEGRLFQVEYAMEAIKLGSTAVGLKTKRGIILAVEKRITSPLLEPSSVEKIMEIDEHVGCAMSGLIADARTLVEHARVETQNHRFSYGEPMSTESTTQALCDLALRFGEGDEDSMSRPFGVSLLIAGHDENGPCLYYTDPSGTFWQCDAKSIGSGVEAADIALKEQYSKDMTLEEAETLALSILKQVMEDKVTANNVDIASVAPTYHLYTPAEVEAVISRL

SEQ ID NO: 3352 - protein, 237 aa, Podocarpus macrophillus
MFLTRSEYDRGVNTFSPEGRLFQVEYAMEAIKLGSTAVGLKTNHGVILAVEKRITSPLLEPSSVEKIMEIDEHIGCAMSGLIADARTLVEHARVETQNHRFSYGEPMSAESTTQALCDLALRFGEGDEDSMSRPFGVSLLIAGHDENGPCLYYTDPSGTFWQSDAKSIGSGVEAADIALKEQYHKEMTLEEAETVALSILKQVMEDKVTANNVDIAKVAPTYHLYTPAEVEAVINRL

SEQ ID NO: 3353 - protein, 214 aa, Solanum tuberosum
MFLTRTEYDRGVNTFSPEGRLFQVEYAIEAIKLGSTAIGIKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNKDLTLKEAETIALSILKQVMEEKVTPNNVD

SEQ ID NO: 3354 - protein, 237 aa, Sequoia sempervirens
MFLTRSEYDRGVNTFSPEGRLFQVEYAMEAIKLGSTAVGLKTNHGVILAVEKRITSPLLEPSSVEKIMEIDEHIGCAMSGLIADARTLVEHARVETQNHRFSYGEPMSAESTTQALCDLALRFGEGDEDSMSRPFGVSLLIAGHDENGPCLYYTDPSGTFWQSDAKSIGSGVEAADISLKEQYRKDMTLEEAETAALSILKQVMEDKVTANNVDIAKVAPTYHLYTPAEVEAVISRL

SEQ ID NO: 3355 - protein, 237 aa, Picea glauca
MFLTRSEYDRGVNTFSPEGRLFQVEYAMEAIKLGSTAVGLKTKRGIILAVEKRITSPLLEPSSVEKIMEIDEHVGCAMSGLIADARTLVEHARVETQNHRFSYGEPMSTESTTQALCDLALRFGEGDEDSMSRPFGVSLLIAGHDENGPCLYYTDPSGTFWQCDAKSIGSGVEAADIALKEQYRKDMTLEEAETLALSILKQVMEDKVTANNVDIASVAPTYHLYTPAEVEAVINRL

SEQ ID NO: 3356 - protein, 213 aa, Flaveria ramosissima
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNKDLTLKEAETVALSILKQVMEEKVTPNNV

SEQ ID NO: 3357 - protein, 237 aa, Pseudotsuga menziesii
MFLTRSEYDRGVNTFSPEGRLFQVEYAMEAIKLGSTAVGLKTKRGIILAVEKRITSPLLEPSSVEKIMEIDEHIGCAMSGLIADARTLVEHARVETQNHRFSYGEPMSTESTTQALCDLALRFGEGDEDSMSRPFGVSLLIAGHDENGPCLYYTDPSGTFWQCDAKAIGSGVEAADIALKDQYRKDMTLEEAETLALSILKQVMEDKVTANNVDIASVAPTYHLYTPAEVEAVINRL

SEQ ID NO: 3358 - protein, 104 aa, Pteridium aquilinum
MFLTRSEYDRGVNTFSPEGRLFQVEYAIEAIKLGSTAVGLKTKEGVVLAVEKRITSTLLEPTSVEKIMEIDSHVWVCHEWFNSRCQDASGTRTGRDSESQVFLQ

SEQ ID NO: 3359 - protein, 237 aa, Marchantia polymorpha
MFLTRSEYDRGVNTFSPEGRLFQVEYAIEAIKLGSTAVGLKTKFGVILAVEKRITSTLLEPSSVDKIMEIDSHIGCAASGLTADAPTLVEHGRVETQNHRFSYNEPMSVESTTQALCDLALRFGEGDEDSMSRPFGVSLLIAGHDETGPCLYITDPSGTFWECDAKAIGSGSEGADSSLQEHYNKEMTLEEAELLALSTLKQVMEEKVTASNVDIAKVAPTYHLYTPAEVEAVIGRL

SEQ ID NO: 3360 - protein, 237 aa, Sciadopitys verticillata
MFLTRSEYDRGVNTFSPEGRLFQVEYAMEAIKLGSTAVGLKTKLGVILAVEKRITSSLLEPSSVEKIMEIDEHIGCAMSGLIADARTLVEHARVETQNHRFSYGEPMSAESTTQALCDLALRFGEGDEDSMSRPFGVSLLIAGYDENGPCLYYTDPSGTFWQSDAKSIGSGVEAADIALKEQYNKDMTLEEAETAALSILKQVMEDKVTANNVDIAKVAPTYHLYSPAEVEAVINRL

SEQ ID NO: 3361 - protein, 237 aa, Abies balsamea
MFLTRSEYDRGVNTFSPEGRLFQVEYAMEAIKLGSTAVGLKTKHGIILAVEKRITSPLLEPSSVEKIMEIDEHIGCAMSGLIADARTLVEHARVETQNHRFSYGEPMSTESTTQALCDLALRFGEGDEDSMSRPFGVSLLIAGHDENGPCLYYTDPSGTFWQCDAKSIGSGVEAADIALKESYRKDMTLEEAESLALSILKQVMEDKVTANNVDIAKVAPTYHLYTPEEVEAVINRL

SEQ ID NO: 3362 - protein, 237 aa, Cedrus atlantica
MFLTRSEYDRGVNTFSPEGRLFQVEYAMEAIKLGSTAVGLKTKRGIILAVEKRITSPLLEPSSVEKIMEIDEHIGCAMSGLIADARTLVEHARVETQNHRFSYGEPMSTESTTQALCDLALRFGEGDEDSMSRPFGVSLLIAGHDENGPCLYYTDPSGTFWQCDAKSIGSGVEAADIALKEQYRKDMALEEAETLALSILKQVMEDKVTANNVDIASVAPTYHLYTPEEVEAVINRL

SEQ ID NO: 3363 - protein, 216 aa, Raphanus sativus
FQVEYAIEAIKLGSTAIGVKTKEGVVLAVEKRITSPLLEPSSVEKIMEIDDHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNKDLSLDEAETIAVSILKQVMEEKVTPNNVDIAKVAPAYHLYTPQEVEAVISRL

SEQ ID NO: 3364 - protein, 217 aa, Camellia sinensis
DRGVNTFSPEGRLFQVEYAIEAIKLGSTAIGLKTKEGVVLAVEKRITSPLLEPSSVEKIMEIDEHIGCAMSGLTADARTLVEHARVETQNYRFSYGEPMTVESTTQALRDLALRFGEGDEESMSRPFGVSLLIAGHDENGPSLYYTDPSGTCWQCNAKATGSGSEGADSSLQEQYNKDITLKEAETIALSILKQVMEEKVTPNNVDIAKVAPTYHLY

SEQ ID NO: 3365 - protein, 217 aa, Nicotiana benthamiana
MFQVEYAIEAIKLGSTAIGIKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNKDLSLKEAETIALSILKQVMEEKVTPNNVDIARVSPTYHLYSPSEVETVISRL

SEQ ID NO: 3366 - protein, 237 aa, Gnetum gnemon
MFLTRSEYDRGVNTFSPEGRLFQVEYAMEAIKLGSTAVGLKTQKGVILAVEKRITSPLLEPSSVEKIMEIDAHIGCAMSGLIADARTLVEHARVETQNHKFSYGEPMSTESTTQALCDLALRFGEGDEDSMSRPFGVSLLIAGYDEKGPCLFYTDPSGTFWQCDAKAIGSGVEAADIALKEQYHKDMALEEAETLALSILKQVMEDKVTPNNVDIACVAPTYHLYGLAEVEAVINRL

SEQ ID NO: 3367 - protein, 273 aa, Saccharum officinarum
MFLTRTEYDRGVNTFSPEGRLFQVEYAIEAIKLGSTAIGLKTKDGVVLAVEKRVTSPLLEPSSVEKIMEIDEHIGCAMSGLIADARTLVEHARVETQNHRFSYGEPMTVESSTQAICDLALRFGEGDEESMSRPFGVSLLIAGHDENGPSLYYTDPSGTFWQCNAKAIGSGSEGADSSLQEQYNKELTLEEAETIALSILKQVMEEKVTPNNVDIGKVAPKYHLYTPAEVEAVIARLENTSELLLFTSSVGNRRSYQAWTSWFLIMAVGVLCC

SEQ ID NO: 3368 - protein, 204 aa, Glycyrrhiza uralensis
MFLTRTEYDRGVNTFSPEGRLFQVEYAIEAIKLGSTAIGLKTKEGVVLAVEKRITSPLLEPSSVEKIMEIDDHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKELTLQEAETIALSILKQVM

SEQ ID NO: 3369 - protein, 207 aa, Papaver somniferum
IKLGSTAIGLKTKEGVVLAVEKRITSPLLEPSSVEKIMEIDEHIGCAMSGLIADARTLVEHARVETQNHKFSYGEPMTVESTTQALCDLALRFGEGEEESMSRPFGVSLLIAGHDENGPSLYYTDPSGTFWQCNAKAIGSGSEGADSSLQEQFNKEMTLQEAETAALSILKQVMEEKVTPNNVDIAKVAPKYHLYSPSEVEAVIARL

SEQ ID NO: 3370 - protein, 207 aa, Raphanus sativus
MFLTRTEYDRGVNTFSPEGRLFQVEYAIEAIKLGSTAIGVKTKEGVVLAVEKRITSPLLEPSSVEKIMEIDDHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNKDLSLDEAETIAVSILKQVMEEK

SEQ ID NO: 3371 - protein, 211 aa, Raphanus sativus
  misc_feature (24)..(24): Xaa can be any naturally occurring amino acid
AIEAIKLGSTAIGVKTKEGVVLAXEKRITSPLLEPSSVEKIMEIDDHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNKDLSLDEAETIAVSILKQVMEEKVTPNNVDIAKVAPAYHLYTPQEVEAVISRL

SEQ ID NO: 3372 - protein, 213 aa, Cyamopsis tetragonoloba
  misc_feature (192)..(192): Xaa can be any naturally occurring amino acid
  misc_feature (207)..(208): Xaa can be any naturally occurring amino acid
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPCLYYTDPSGTFWQCNAKAIGSGSEGADSSLQEQYNKDLTLQEXETIALSILKQVMGRXXHSQQC

SEQ ID NO: 3373 - protein, 207 aa, Papaver somniferum
IKLGSTAIGLKTKEGVVLAVEKRITSPLLEPSSVEKIMEIDEHIGCAMSGLIADARTLVEHARVETQNHKFSYGEPMTVESTTQALCDLALRFGEGEEESMSRPFGVSLLIAGHDENGPSLYYTDPSGTFWQCNAKAIGSGSEGADSSLQEQFNKEMRLQEAETVALSILKQVMEEKVTPNNVDIAKVAPKYHLYSPSEVEAVIARL

SEQ ID NO: 3374 - protein, 198 aa, Linum usitatissimum
MKTKEGVVLAVEKRITSPLLEPSSVEKVMEIDQHIGCAMSGLIADARTLVEHARVETQSHRFSYGEPMTVESTTQALCDLALRFGEGDEESMSRPFGVSLLIAGHDENGPSLYYTDPSGTFWQCNAKAIGSGSEGADSSLQEQYNKDLTLLEAETIALSILKQVMEEKVTPNNVDIAKVSPTYHLYTPAEVEAVIGRL

SEQ ID NO: 3375 - protein, 205 aa, Gerbera hybrid cultivar
LGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNGKAIGSGSEGADSSLQEQYNKDLTLKEAETIALSILKQVMEEKVTPNNVDIAKVAPTYHLYTPAEVEAVINRL

SEQ ID NO: 3376 - protein, 228 aa, Distylium racemosum
EESNTFSPEGRLFQVEYAMEAIKLGSTAVGLKTNHGVILAVEKRITSPLLEPSSVEKIMEIDEHIGCAMSGLIADARTLVEHARVETQNHRFSYGEPMSAESTTQALCDLALRFGEGDEDSMSRPFGVSLLIAGHDEKGPCLYYTDPSGTFWQSDAKSIGSGVEAADIALKEQYRKDMTLEEAETAALSILKQVMEDKVTANNVDIAKVAPTYHLYTPAEVEAVINRL

SEQ ID NO: 3377 - protein, 221 aa, Eragrostis curvula
MFLTRTEYDRGVNTFSPEGRLFQVEYAIEAIKLGSTAIGLKTKDGVVLAVEKRVTSPLLEPSSVEKIMEIDEHLGCAMSGLIADARTLVEHARVETHNHRFSYGEPMTVESATQAICDLALRFGEGDEESMSRPFGVSLLIAGHDENGPNLYYTDPSGTFWLCNAKAIGSVLKELTAHCRNSTTRKLTLQEAQTIALSILNQVMDKKVTPNNVHIAKGAPN

SEQ ID NO: 3378 - protein, 131 aa, Vaccinium corymbosum
MTVESTTQALCDLALRFGEGDEESMSRPFGVSLLIAGHDENGPSLYYTDPSGTFWQCNAKAIGSGSEGADSSLQEQYNKDITLKEAETVALSILKQVMEEKVTPNNVDIAKVAPTYHLYTPSEVEAVISRL

SEQ ID NO: 3379 - protein, 143 aa, Papaver somniferum
GSTAIGLRTKEGVVLAVEKRITSPLLEPSSVEKIMEIDEHIGCAMSGLIADARTLVEHARVETQNHKFSYGEPMTVESTTQALCDLALRFGEGEEESMSRPFGVSLLIAGHDENGPSLYYTDPSGTFWQCNAKAIGSGSEGAR

SEQ ID NO: 3380 - protein, 534 aa, Hordeum vulgare
MAMELSMALAAPPGGGLLAPPPPAPPGKEQQVAGVGILLQISMLVLSFVLGHVLRRHRFYYLPEASASLLIGLVVGGLANISNTETNTRTWFNFHEEFFFLFLLPPIIFQSGFSLSPKPFFANFGAIVTFAILGTFIASIVTGMLVYLGGLTFLMYKLPLVECLMFGALISATDPVTVLSIFQELGSDVNLYALVFGESVLNDAMAISLYRTMSSVRSNAAGGENIFMMILQFLEIFVGSMSSGVGVGFISSLLFKYAGLDIDNLQNLECCLFVLFPYFSYMLAEGLGLSGIVSILFTGMVMKHYTYSNLSDNSQRFVSAFFHLLSSLAETFVFIYMGFDIAMEEHSWSHVGFIIFSIIFIIVARAANVFSCAYLVNISRPEHRRIPLNHQKALCFSGLRGAMAFALALQSVHELPEGHGKTILTATTAIVVLTVLLIGGSTGTMLEALDVIGDENTSIETYEDNNGYIPPTYEEGTSSGGGLRMKLKEFHKSTTSFTALDKNYLTPFFTSQTDDDADDFGDQPQNQRQGFYDQ

SEQ ID NO: 3381 - protein, 536 aa, Sorghum bicolor
MALELRLASASPPAGGGLAQPPPLAPPGKEQQVAGVGILLQISMLVLSFVLGHVLRRHRFYYLPEASASLLIGLVVGGLANISNTETNTRTWFNFHEEFFFLFLLPPIIFQSGFSLSPKPFFANFGAIVTFAILGTFIASVVTGVLVYLGGLTFLMYKLPLVECLMFGALISATDPVTVLSIFQELGSDVNLYALVFGESVLNDAMAISLYRTMSSVRSHAAGGENLFMMILQFLETFVGSMSSGVGVGFISALLFKYAGLDVDNLQNLECCLFVLFPYFSYMLAEGLGLSGIVSILFTGMVMKHYTYSNLSDNSQRFVSAFFHLLSSLAETFVFIYMGFDIAMEEHSWSHVGFIFFSIIFIVVARAANVFSCAYLVNMSRPQHRRIPLKHQKALWFSGLRGAMAFALALQSVHELPEGHGKTIFTTTTAIVVLTVLLIGGSTGTMLEALDVVGDENTSIENYEDNNGYMPPSYEEGTSSGGGLRMKLKQFHKSTTSFTALDKNYLTPFFTSQTDDDDDDFTGQQPQNRRLAFYDQ

SEQ ID NO: 3382 - protein, 536 aa, Setaria italica
MALELSLASASASPPAGWLAPPPPLAPPGKEQQVAGVGILLQISMLVLSFVLGHVLRRHRFYYLPEASASLLIGLVVGGLANISNTETNTRTWFNFHEEFFFLFLLPPIIFQSGFSLSPKPFFANFGAIVTFAILGTFIASVVTGVLVYLGGLTFLMYKLPLVECLMFGALISATDPVTVLSIFQELGSDVNLYALVFGESVLNDAMAISLYRTMSSVRSHAAAGENFFMMILQFLETFVGSMSSGVGVGFISALLFKYAGLDVDNLQNLECCLFVLFPYFSYMLAEGLGLSGIVSILFTGMVMKHYTFSNLSDNSQRFVSAFFHLLSSLAETFVFIYMGFDIAMEEHSWSHVGFIFFSIIFIVVARAVNVFSCAYLVNMSRPEHRRIPLKHQKALWFSGLRGAMAFALALQSVHELPEGHGKTIFTTTTAIVVLTVLLIGGSTGTMLEALDVVGDENTSIENYEDNNGYMPPTYEEGTSSGGGLRMKLKQFHKSTTSFTALDKNYLTPFFTSQTDDDDDDFSEQPQNRRVRFYDQ

SEQ ID NO: 3383 - protein, 536 aa, Zea mays
MALELSLASASPPAGGGLAQPPPLAPPGKEQQVAGVGILLQISMLVLSFVLGHVLRRHRFYYLPEASASLLIGLVVGGLANISNTETNTRTWFNFHEEFFFLFLLPPIIFQSGFSLSPKPFFANFGAIVTFAILGTFIASVVTGVLVYLGGLTFLMYKLPLVECLMFGALISATDPVTVLSIFQELGSDVNLYALVFGESVLNDAMAISLYRTMSSVRSHAAGGENFFMMILQFLETFVGSMSSGVGVGFISALLFKYAGLDVDNLQNLECCLFVLFPYFSYMLAEGLGLSGIVSILFTGMVMKHYTYSNLSDNSQRFVSAFFHLLSSLAETFVFIYMGFDIAMEEHSWSHVGFIFFSIIFIVVARAANVFSCAYLVNMSRPEHRRIPVKHQKALWFSGLRGAMAFALALQSVHELPEGHGKTIFTTTTAIVVLTVLLIGGSTGTMLESLDVVGDENTSRENYEDNNGYMPPSYEEGTSSGGGLRMKLKQFHKSTTSFTALDKNYLTPFFTSQTDDDNDDDFSQQPQNRRLAFYDQ

SEQ ID NO: 3384 - protein, 503 aa, Triticum aestivum
AGVGILLQISMLVLSFVLGHVLRRHRVYYLPEASASLLIGLVVGGLANISNTETNTRTWFNFHEEFFFLFLLPPIIFQSGFSLSPKPFFANFGAIVTFAILGTFIASIVTGMLVYLGGLTFLMYKLPLVECLMFGALISATDPVTVLSIFQELGSDVNLYALVFGESVLNDAMAISLYRTMSSVRSNAAGGENIFMMILQFLEIFVGSMSSGVGVGFISALLFKYAGLDIDNLQNLECCLFVLFPYFSYMLAEGLGLSGIVSILFTGMVMKHYTYSNLSDNSQRFVSAFFHLLSSLAETFVFIYMGFDIAMEEHSWSHVGFIIFSIIFIIVARAANVFSCAYLVNISRPEHRRIPLNHQKALCFSGLRGAMAFALALQSVHELPEGHGKTILTATTAIVVLTVLLIGGSTGTMLEALDVIGDENTSIETYEDNNNGYIPPTYEEGTSSGGGLRMKLKEFHKSTTSFTALDKNYLTPFFTSQTDDDADDFGDQPQNQRRGFYDQ

SEQ ID NO: 3385 - protein, 535 aa, Oryza sativa
MALELSLVSASPPGGLAASPPPPAAIPGKEQQVAGVGILLQISMLVLSFVLGHVLRRHRFYYLPEASASLLIGLVVGGLANISNTETNTRMWFNFHDEFFFLFLLPPIIFQSGFSLSPKPFFANFGAIVTFAILGTFIASVVTGVLVYLGGLTFLMYKLPFVECLMFGALISATDPVTVLSIFQELGTDVNLYALVFGESVLNDAMAISLYRTMSLVRSQAAAGENFFMMVFQFLETFVGSLSSGVGVGFISALLFKYAGLDIDNLQNLECCLFVLFPYFSYMLAEGLGLSGIVSILFTGMVMKHYTFSNLSNNSQRFVSAFFHLLSSLAETFVFIYMGFDIAMEEHSWSHVGFIFFSIIFIIIARAVNVFSCAYLVNMSRPEHRRIPLKHQKALWFSGLRGAMAFALALQSANELPGGHGKTIFTTTTAIVVLTVLLIGGSTGTMLEALDVIGDENRSIENYDDNNGYIPPTYEEGSSSGGGLRMKLKEFHKSTTSFTALDRNYLTPFFTSQTDEDDDVFGEQPQNQRRGFYDQ

SEQ ID NO: 3386 - protein, 529 aa, Panicum virgatum
MELGLSLASASPPAGGLAPPPPLAPPGKEQQVAGVGILLQISMLVLSFVLGHVLRRHRFYYLPEASASLLIGLVVGGLANISNTETNTRTWFNFHEEFFFLFLLPPIIFQSGFSLSPKPFFANFGAIVTFAILGTLIASVVTGVLVYLGGLTFLMYKLPLVECLMFGALISATDPVTVLSIFQELGSDVNLYALVFGESVLNDAMAISLYRTMSSVRSHAAVGENFFMMILQFLETFVGSMSSGVGVGFISALLFKYAGLDVDNLQNLECCLFVLFPYFSYMLAEGLGLSGIVSILFTGMVMKHYTYSNLSDNSQRFVSAFFHLLSSLAETFVFIYMGFDIAMEEHSWSHVGFIFFSIIFIVVARAVNVFSCAYLVNMSRPEHRRIPLKHQKALWFSGLRGAMAFALALQSVHELPEGHGKTIFTTTTAIVVLTVLLIGGSTGTMLEALDVVGDENPSIETYEDNNGFMPPTYEEGTSSGGGLRMKLKQFHKSTTSFTALDKNYLTPFFTSQTDDDDDDASVGNPKTDE

SEQ ID NO: 3387 - protein, 499 aa, Triticum aestivum
GILLQISMLVLSFVLGHVLRRHRFYYLPEASASLLIGLVVGGLANISNTETNTRTWFNFHEEFFFLFLLPPIIFQSGFSLSPKPFFANFGAIVTFAILGTFIASIVTGMLVYLGGLTFLMYKLPLVECLMFGALISATDPVTVLSIFQELGSDVNLYALVFGESVLNDAMAISLYRTMSSVRSNAAGGENIFMMILQFLEIFVGSMSSGVGVGFISSLLFKYAGLDIDNLQNLECCLFVLFPYFSYMLAEGLGLSGIVSILFTGMVMKHYTYSNLSDNSQRFVSAFFHLLSSLAETFVFIYMGFDIAMEEHSWSHVGFIIFSIIFIIVARAANVFSCAYLVNISRPEHRRIPLNHQKALCFSGLRGAMAFALALQSVHELPEGHGKTILTATTAIVVLTVLLIGGSTGTMLEALDVIGDENTSIETYEDNNGYIPPTYEEGTSSGGGLRMKLKEFHKSTTSFTALDKNYLTPFFTSQTDDDADDFGDQPQNQRRGFYDQ

SEQ ID NO: 3388 - protein, 508 aa, Pennisetum glaucum
MALELSLASVSPSPPAGVLAPPPPLAPPGKEQQVAGVGILLQISMLVLSFVLGHVLRRHRFYYLPEASASLLIGLVVGGLANISNTETNTRTWFNFHEEFFFLFLLPPIIFQSGFSLSPKPFFANFGAIVTFAILGTFIASVVTGVLVYLGGLTFLMYKLPLVECLMFGALISATDPVTVLSIFQELGSDVNLYALVFGESVLNDAMAISLYRTMSSVRSHAAAGENFFMMILQFLETFVGSMSSGVGVGFISALLFKYAGLDVDNLQNLECCLFVLFPYFSYMLAEGLGLSGIVSILFTGMVMKHYTFSNLSDNSQRFVSAFFHLLSSLAETFVFIYMGFDIAMEEHSWSHVGFIFFSIIFIVVARAVNVFSCAYLVNMSRPEHRRIPLKHQKALWFSGLRGAMAFALALQSVHELPEGHGKTIFTTTTAIVVLTVLLIGGSTGTMLEALDVVGDENTSIENYEDNNGYMPPTYEEGTSSGGGLRMKLKQFHKSAARHHSLPLTRTT

SEQ ID NO: 3389 - protein, 469 aa, Triticum aestivum
SASLLIGLVVGGLANISNTETNTRTWFNFHEEFFFLFLLPPIIFQSGFSLSPKPFFANFGAIVTFAILGTFIASIVTGMLVYLGGLTFLMYKLPLVECLMFGALISATDPVTVLSIFQELGSDVNLYALVFGESVLNDAMAISLYRTMSSVRSNAAGGENIFMMILQFLEIFVGSMSSGVGVGFISALLFKYAGLDIDNLQNLECCLFVLFPYFSYMLAEGLGLSGIVSILFTGMVMKHYTYSNLSDNSQRFVSAFFHLLSSLAETFVFIYMGFDIAMEEHSWSHVGFIIFSIIFIIVARAANVFSCAYLVNISRPEHRRIPLNHQKALCFSGLRGAMAFALALQSVHELPEGHGKTILTATTAIVVLTVLLIGGSTGTMLEALDVIGDENTSIETYEDNNGYIPPTYEEGTSSGGGLRMKLKEFHKSTTSFTALDKNYLTPFFTSQTDEDADDFGDQPQNQRRGFYDQ

SEQ ID NO: 3390 - protein, 245 aa, Avena sativa
MVKLVQDEENQRLLLDDHKEKHFTSGEVVRDIIIGVSDGLTVPFALAAGLSGANASSALVLTAGLAEVAAGAISMGLGGYLAAKSDADHYYRELQREQDEIDTVPDTEAAEIAEILSEYGLGPEEYGPVVTSLRNNPKAWLEFMMKFELGLEKPDPRRALTSAATIALAYVVGGLVPLSPYMFVPSVDRAMLTSVVVTLAALLFFGYVKGRFTGNRPFLSAIQTAVIGALASSAAYGMAKAVQAV

SEQ ID NO: 3391 - protein, 245 aa, Unknown
  Sequence found in Organisms: Leymus cinereus x Leymus triticoides, Secale cereale, Triticum aestivum
MVKPVQDEENQRLLLDDHKEKHFTSGEVVRDIIIGVSDGLTVPFALAAGLSGANASSSLVLTAGLAEVAAGAISMGLGGYLAAKSDADHYYRELQREQDEIDTVPDTEAAEIADILSEYGLGPEEYGPVVTSLRNNPKAWLEFMMKFELGLEKPDPRRALTSAATIALAYVVGGMVPLSPYMFVASVDSAMMTSVVVTLAALLFFGYVKGRFTGNRPFLSAIQTAIIGALASSAAYGMAKAVQAI

SEQ ID NO: 3392 - protein, 245 aa, Hordeum vulgare
MVKPVQDEENQRLLLDDHKEKHFTSGEVVRDIIIGVSDGLTVPFALAAGLSGANASSSLVLTAGLAEVAAGAISMGLGGYLAAKSDADHYYRELQREQDEIDTVPDTEAAEIADILSEYGLGPEEYGPVVTSLRNNPKAWLEFMMKFELGLEKPDPRRALTSAATIALAYVVGGMVPLSPYMFVASVDSAMMTSVVVTLAALLFFGYVKGRFTGNRPFLSAIQTAIIGALASSAAYGMAKAVQAV

SEQ ID NO: 3393 - protein, 246 aa, Oryza sativa
MVKEFVQDEEKQRLLLDEHTEKHFTAGEVVRDIIIGVSDGLTVPFALAAGLSGANAPSALVLTAGLAEVAAGAISMGLGGYLAAKSDADHYHRELQREQEEIDTVPDTEAAEIADILSQYGLGPEEYGPVVNSLRSNPKAWLEFMMKFELGLEKPEPRRALMSAGTIALAYVVGGLVPLLPYMFVPTADRAMATSVVVTLAALLFFGYVKGRFTGNRPFISAFQTAVIGALASAAAFGMAKAVQSI

SEQ ID NO: 3394 - protein, 250 aa, Setaria italica
MALNGGKTYVQDEEKQRLLLEEHTEKHFTAGEVVRDIIIGVSDGLTVPFALAAGLSGANASSALVLTAGLAEVAAGAISMGLGGYLAAKSEADHYNRELQREQDEIDTVPDVEAAEIADILSQYGLGPEEYGPVVTSLRNNPKAWLEFMMKFELGLEKPEPRRALVSAATIALSYVAGGLVPLLPYVFVPRAERAMAVSVAVTLAALLFFGFVKGRFTGDRPFLSAVQTTVVGALASAAAYAMARAVQSI

SEQ ID NO: 3395 - protein, 252 aa, Pennisetum glaucum
MALINGGGKTFVQDEEKQQLLLEEHTEKHFTAGEVVRDIIIGVSDGLTVPFALAAGLSGANASSALVLTAGLAEVAAGAISMGLGGYLAAKSEADHYSRELQREQDEIDTVPDVEAAEIADILSQYGLGPAEYGPVVTSLRNNPKAWLEFMMKFELGLEKPDPRRALVSAATIALSYVAGGLVPLLPYVFVPRAERAMAVSVAVTLAALLFFGFVKGRFTGDRPFLSAVQTTVIGALASAAAYGMARAVQSI

SEQ ID NO: 3396 - protein, 250 aa, Zea mays
MALNGGKTFVHDEEKQRLLLEEHTEKHFTAGEVVRDIIIGVSDGLTVPFALAAGLSGANASSALVLTAGLAEVAAGAISMGLGGYLAAKSEADHYNRELQREQDEIDTVPDVEAAEIADILSEYGLGPQEYGPVVTSLRNNPKAWLEFMMKFELGLEKPEPRRALVSAATIALSYVAGGLVPLLPYMFVPEAGRAMAVSVAVTLAALLFFGFVKGRFTGDRPFFSAVQTTVVGALASAAAYAMARAVQSI

SEQ ID NO: 3397 - protein, 251 aa, Zea mays
MALNGGKTTLVQDEEKQQLLLEKHTEKHFTAGEVVRDIIIGVSDGLTVPFALAAGLSGANASSALVLTAGLAEVAAGAISMGLGGYLAAKSEADHYNRELQREQDEIDTVPDVEAAEIADILSQYGLGPEEYGPVVTSLRNNPKAWLEFMMKFELGLERPEPRRALVSAATIALSYVAGGLVPLLPYMFVPEAARAMAVSVAVTLAALLFFGFVKGRFTGDRPFFSAVQTTVVGALASAAAFAMARAVQSI

SEQ ID NO: 3398 - protein, 251 aa, Sorghum bicolor
MAALNGGKTFVQDEEKQQLLLEEHTEKHFTAGEVVRDIIIGVSDGLTVPFALAAGLSGANASSALVLTAGLAEVAAGAISMGLGGYLAAKSEADHYNRELQREQDEIDTVPDVEAAEIADILSQYGLGPSEYGPVVTSLRNNPKAWLEFMMKFELGLEKPEPRRALVSAATIALSYVAGGLVPLLPYMIVPEAGRAMAVSVAVTLAALLFFGFVKGRFTGDRPFFSAVQTTVVGALASAAAYAMARAVQSI

SEQ ID NO: 3399 - protein, 251 aa, Panicum virgatum
MALIGGSKAFVQDEEKQRLLLEEHTEKHFTASEVVRDIIIGVSDGLTVPFALAAGLSGANASSALVLTAGLAEVAAGAISMGLGGYLAAKSEADHYNRELQREQEEIDTVPDVEAAEIADILSQYGLGPAEYGPVVTSLRGNPKAWLEFMMKFELGLERPEPRRALVSAATIALSYVAGGLVPLLPYVFVPRAGRAMAVSVAVTLAALLFFGFVKGRFTGDRPFLSAVQTTVVGALASAAAYAMARGVQSI

SEQ ID NO: 3400 - protein, 251 aa, Panicum virgatum
MALIGGSKAFVQDEEKQRLLLEEHTEKHFTASEVVRDIIIGVSDGLTVPFALAAGLSGANASSALVLTAGLAEVAAGAISMGLGGYLAAKSEADHYNRELQREQEEIDTVPDVEAAEIADILSQYGLGPAEYGPVVASLRGNPAAWLEFMMRFELGLERPEPRRALVSAATIALSYVAGGLVPLLPYVFVPRAGRAMAVSVAVTLAALLFFGFVKGRFTGDRPFLSALQTTVVGALASAAAFAMARAVQSI

SEQ ID NO: 3401 - protein, 567 aa, Panicum virgatum
MSLDELADKEASSPEEIQLVQSDAKFRSFSPPPIPIPAAPGIRSLVDSVSDERLDVIASHQRENGSISTVSSTVSSLESEKAAYEFLAQTPIKSTDAHLVEFSEAMRTVAKALRRVAEGKAAAQAEATEWKRKYELEMAHKQQSKVKGCGSYINNDLDKLASQLTLDTAASDQLGCCGKHGICSHEVLQDEVPGPIPRSNHKMVGRKASFKLSWGCNGDKNGQHKHDFVSFEKGDITTTERSNKQILLKWESQPQTVLFITKPNSNSVRVLCAEMVRWLKEHKNINVFVEPRVSKELITEDSSYNFVQTWDNDDEIKLLHTKVDLIVTLGGDGTVLWAASLFKGPVPPVVAFSLGSLGFMTPFLSEQYRDCLDNVLNGPFSITLRNRLQCHVIRDAAKEELVTEEPILVLNEVTIDRGISSYLTYLECYCDSSFVTCVQGDGLIISTTSGSTAYSLAAGGSMVHPQVPGILFTPICPHSLSFRPLILPEYVTLRVQVPYNSRGSAWASFDGKDRKQLSPGDALICSISPWPVPTACLADSTTDFLRSIHEGLHWNLRKSQSFDGPRD

SEQ ID NO: 3402 - protein, 557 aa, Pennisetum glaucum
EIQVAQQPDSKFRSFNPGPIPIPPAAPPTVRSLAHSVSDERVDVLASHQSENGSGSISTASSTVSSLEVEKAAYEYLAQTPIKSTDAHLVEFSEAMRTVAKALRRVAEGKAAAQAEAAEWKRKYELEMAHKQQSKIKGCGSCVSNDLDKLASQLTLETSASDQLGCCGKHGICSHEVLQDEVPGPIPRPNHKMVGRKASFKLSWGCNGDKNGQHKHDFVSFEKGDITTAERSSKQILLKWESPPQTVLFITKPNSNSVHLLCAEMVRWLKEHKNINVFVEPRVSKELLTEDSSYNFVQTWDDDEEIKQLHTKVDLIVTLGGDGTVLWAASLFKGPVPPVVAFSLGSLGFMTPFPSEQYRDCLDNVLNGPFSITLRNRLQCHVIRDAAKDELVTEEPILVLNEVTIDRGISSYLTYLECYCDSSFVTCVQGDGLIISTTSGSTAYSLAAGGSMVHPQVPGILFTPICPHSLSFRPLILPEYVTLRVQVPYNSRGHAWASFDGKDRRQLSPGDALICSISPWPVPTACVMDSTTDFMRSIQEGLHWNLRKPQSFDGPRD

SEQ ID NO: 3403 - protein, 568 aa, Sorghum bicolor
MSLDELADKEPSSSEEVQLAPSDSKFRSIGPAPIPIPAPPSIRSLVDSVSDERVNVDIVASHQSENGSISTASSTGSLESEKAAYEFLAQTPVRSTDAHLVEFSEAMRTVAKALRRVAEGKAAAQAEAAEWKRKYELETAHKQQSKIKGYNSCISNDLDKLASQLTLETPAPDQLGCCGKHGICAHEVLQDEVPGPIPRSNHKVVGRKASFKLSWGCNGDKNGQHKHDFVSFEKGDITTAERSNKQILLKWESPPQTVLFITKPNSNSVRVLCAEMVRWLRESKNINIFVEPRVRKELLTEDSYYNFVQTWDNDEEIKMLHTKVDLIVTLGGDGTVLWAASLFKGPVPPVVAFALGSLGFMTPFPSEQYRELLDNVLNGPFSITLRNRIQCHVIRDAAKDEIMTEEPFLVLNEVTIDRGISSYLTNLEVYCDSSFVTCVQGDGLIISTTSGSTAYSLAAGGSMVHPQVPGILFTPICPHSLSFRPLILPEYVTLRVQVPYNSRGAAWASFDGKDRQQLSPGDALICSISPWPVPTACLVDSTTDFFRSIHEGLHWNLRKSQSFDGPRD

SEQ ID NO: 3404 - protein, 1013 aa, Oryza sativa
MATPIALLLFVLVVAAAADSTMPMPVNEEVLGLVVFKSALSDPSGALATWTESDATPCGWAHVECDPATSRVLRLALDGLGLSGRMPRGLDRLAALQSLSVARNNLSGELPPGLSLLASLRSIDLSYNAFSGPLPGDVPLLASLRYLDLTGNAFSGPLPATFPATVRFLMLSGNQFSGPLPQGLSKSSFLLHLNLSGNQLSGSPDFAGALWPLSRLRALDLSRNQFSGTVTTGIANLHNLKTIDLSGNRFFGAVPSDIGLCPHLSTVDISSNAFDGQLPDSIAHLGSLVYFAASGNRFSGDVPAWLGDLAALQHLDFSDNALTGRLPDSLGKLKDLRYLSMSENQLSGAIPDAMSGCTKLAELHLRANNLSGSIPDALFDVGLETLDMSSNALSGVLPSGSTKLAETLQWLDLSVNQITGGIPAEMALFMNLRYLNLSRNDLRTQLPPELGLLRNLTVLDLRSSGLYGTMPSDLCEAGSLAVLQLDGNSLAGPIPDNIGNCSSLYLLSLGHNSLTGPIPVGMSELKKLEILRLEYNNLSGEIPQQLGGIESLLAVNVSHNRLVGRLPASGVFQSLDASALEGNLGICSPLVTQPCRMNVAKPLVLDPNEYPHGGDGDNNLETSGRGPASPRKRRFLSVSAMVAICAAVFIILGVIVITLLNMSARRRAGDGGTTTPEKELESIVSSSTKSSKLATGKMVTFGPGNSLRSEDFVGGADALLSKATEIGRGVFGTVYRASVGEGRVVAIKKLATASIVESRDDFDREVRILGKARHPNLLPLKGYYWTPQLQLLITDYAPHGSLEARLHGNGDGAFPPLTWAERFRIVAGTARGLAHLHQSFRPPMIHYNVKPSNILLDEQCNPMVGDFGLARLLPKLDKHVMSSRFQGGMGYVAPELACQSLRINEKCDIYGFGVLILELVTGRRAVEYGDDDVVILIDQVRVLLDHGGGSNVLECVDPSIGEFPEEEVLPVLKLGMVCTSQIPSNRPSMAEVVQILQVIKAPVAASSARIEAF

SEQ ID NO: 3405 - protein, 569 aa, Zea mays
MSHDELADKEPSSSEEFQLAPTGSKFRSLSPAPIPIPASPGIRSLVDSVSDETVNVDVMASHQSENGSISTASSTVSLLESEKAAYEFLAQTPVRSTDAHLIEFSEALRTVAKALRQVAEGKAAAQAEAAEWKRKYELETAQKQQSKIRGYSSCISNNLDKLASQLTLETPAPDQLGCCGKHGICAHQVLQDEVPGPIPRSNHKVGGRKAPFKLSWGCNGDKNGQHKHDFVSFEKGDITTAERSNKQILLKWESPPQTVLFITKPNSSSVRVLCAEMVRWLREYKNVNIFVDPRVSKELLTEDSYYNFVQTWDNDDDIKMLHTKVDLIVTLGGDGTVLWAASLFKGPVPPVVAFALGSLGFMTPFPSEHYRELLDNVLNGPFSITLRNRIQCHVIRDAAKDEIVTEEPFLVLNEVTIDRGISSYLTNLEVYCDSSFVTCVQGDGLIISTTSGSTAYSLAAGGSMVHPQVPGILFTPICPHSLSFRPLILPEYVTLRVQVPYNSRGHAWASFDGKDRKQLSPGDALICSISPWPVPTACLVDSTTDFFRSIHEGLHWNLRKSQSFDGPRD

SEQ ID NO: 3406 - protein, 565 aa, Zea mays
MPLDELADKGPSSSEEVQLAPSDSKFRSLSPSPIPLPTLPSIRSLVHSVSDESVNVDVAASHQSENGSISTVSSLESERAAYEFLAQTPVRSTDAHLVEFSEAMRTVAKALRRVAEGKAAAQAEAAEWKRKYELETAHKHRSKIKGYSSCINNDLDKLVSQLTLETPTSDQLGCCGKHGICAHEILQDEVPGPIPRSNHKVVGRKASFKLSWGCNGDKNGQHKHDFVSFEKGDITTAERSNKQILLKWESPPQTVLFITKPNSNSVRVLCAEMIRWLREHKNINIFVEPRVSKELLTEDSYYNFVQTWDNDEEIKMLRTKVDLIITLGGDGTVLWAASLFKGPVPPVVAFALGSLGFMTPFPSEQYRELLDNVLNGPFSITLRNRIQCHVIRDEAKDEIVSEEPFLVLNEVTIDRGISSYLTNLEVYCDSSFVTCVQGDGLIISTTSGSTAYSLAAGGSMVHPQVPGILFTPICPHSLSFRPLILPEYVTLRVQVPFNSRGNAWASFDGKDRQQLSPGDALICSISPWPVPTACLVDSTTDFLRSIHEGLHWNLRKSQSFDGPRD

SEQ ID NO: 3407 - protein, 572 aa, Hordeum vulgare
GLYLLLTDECLVFSLPQDAAQLAQQPDSRFRSLNPGPIPIPAAPSSRSLLDKVSDQTVDLDLTASHQSENGSISTVSSTVSSVESEKAAYEFLAQTPIKSTDKHLVEFSEAMRTVAKALRQVAEGKAAAQAEAAEWKRKYELETAQKQQTRIKDCGTCTDDNLGKMASQLSLEAPASDQTGCCGNHGICSHEVLQDEVPEPNARPSLSMVGRKASFRLSWGCNGNKNGQHKHDFVSFEKGDITTAERSSKQILLKWESRPQTVLFITKPNSNSVRVLCAEMVRWLKEHKNINVFVEPWVSKELLTDDSNHTVQTWDNDDDKKMLHKKVDLIVTLGGDGTVLWAASLFKGPVPPVVAFAMGSLGFMTPFQSEKYRHYLDNVLKGPFSITLRNRLQCHVIRDAAKDELVTEDPILVLNEVTIDRGISSYLTYLECYCDSSFVTCVQGDGLIISTTSGSTAYSLAAGGSMVHPQVPGILFTPICPHSLSFRPLILPEYVTLRIQVPYNSRGHAWASFDGKDRKQLAPGDALICSISPWPVPTACLVDSTTDFLRSIHEGLHWNLRKTQSLDGPRD

SEQ ID NO: 3408 - protein, 531 aa, Brachypodium distachyon
MDRAAMPAQEVSDQRVNLDVISSYQSENGSLSTVSSTVSSEESEKAAYELLAHTPIKSTDAHLVEFSEAMRTVAKALRRVAEGKAAAQAEAAEWKRKYELETAQKQQTKIKDCGSSTGNNLGKLASQRTLETPASDQTACCGNHGICSHEVLQDEVPGSNPRSSHKMVGRKASFRLSWGCNGDKNGQHKHDFVSFEKGDITTAERSNKQILLRWESRPQTVLFITKPNSNPVRVLCAEMVRWLKEHKNINVFVEPWVSKDLLTEDSSHNLVQTWDNDEERKVLHKKVDLIVTLGGDGTVLWAASLFKGPVPPVVAFSMGSLGFMTRFPSQQYRDCLDNVLNGPFSITLRNRLQCRVIRDAAKDELETEEPILALNEVTIDRGISSYLTYLECYCDSSFVTCVQGDGLIISTTSGSTAYSLAAGGSMVHPQVPGILFTPICPHSLSFRPLILPEYVTLRVQVPYNSRGHAWASFDGKDRKQLAPGDALICSISPWPVPTACLVDSTTDFLHSIHEGLHWNLRKTQSLDGPRD

SEQ ID NO: 3409 - protein, 575 aa, Secale cereale
MATDAARSQPDHAAMPLGEPAHQEAVQQLAPQPDTRLRSLNPGPIPIPAAPSSRSLLDTVSDQTVNLDLTGSHQSENGSISTVSSVESEKAAYEFLAQTPIKSTDKHLVEFSEAMRTVAKALRQVAEGKAAAQAEAAEWKRKYELETAQKQQTRIKDCGTCTDDNLGKMASQLSLEAPASDQTGCCGNHGICSHEVLQDEVPGPNPRPSLSMVGRKASFRLSWGCNGNKNGQHKHDFVSFEKGDITTAERSSKQILLKWESRPQTVLFITKPNSNSVRVLCAEMVRWLKEHRNINVFVEPWVSKELLTDDSNNTVQTWDNDDDKKMLHKKVDLIVTLGGDGTVLWAASLFKGPVPPVVAFAMGSLGFMTPFESEKYRDCLDNVLKGPFSITLRNRLQCHVIRDAAKDEIVTEEPILVLNEVTIDRGISSYLTYLECYCDSSFVTCVQGDGLIISTTSGSTAYSLAAGGSMVHPQVPGILFTPICPHSLSFRPLILPEYVTLRIQVPYNSRGHAWASFDGKDRKQLFPGDALICSISPWPVPTACLVDSTTDFLRSINEGLHWNLRKTQTLDGPRD

SEQ ID NO: 3410 - protein, 539 aa, Oryza sativa
MEVFGPVTAGQVSFLLGLFPVLIAWIYSEVLEYRKSSSMKVHSDSNLENGTVKEDDKTVLLEGGLSKSPSTKFRINSTKANLIRFITMDESFLLENRAVLRAMAEFGIVLVYFYICDRTNIFPESKKSYNRDLFLFLYILLIIASALTSLKKHHDKSAFSGKSILYLNRHQTEEWKGWMQVLFLMYHYFAATEIYNAIRVFIAAYVWMTGFGNFSYYYIKKDFSLARFAQMMWRLNFFVAFCCIVLDNDYMLYYICPMHTLFTLMVYGSLGLFNKYNEIPSVMAMKIVSCFLAVILIWEIPGVFELLWSPFTFLLGYKDPEPSKANLPLLHEWHFRSGLDRYIWIIGMIYAYFHPNVERWMEKLEESETKVRLSIKGTIISISLVAGYLWYEYIYKLDKITYNKYHPYTSWIPITVYISLRNCTQQLRNVSLTLFAWLGKITLETYISQIHIWLRSNMPNGQPKWLLSFIPGYPLLNFMLATAIYLLISYRVFELTGVLKSAFIPSRDNNRLYQNFVAGIAISVCLYFLSIVLLKIPIV

SEQ ID NO: 3411 - protein, 540 aa, Setaria italica
MEVFGPVTPGQVSFLLGLFPVLIAWIYSEILEYRKSSSHGKVHSDANLDNGTIKEEDKTVLLEGGQLKSPSTKFRNLSTKANLIRFITMDESFLLEHRAVLRAMAEFGIVLVYFYICDRTNIFPESKKSYNRDLFLFLYILLIIASALTSLKKHHEKSAFTGKSILYLNRHQTEEWKGWMQVLFLMYHYFAASEIYNAIRVFIACYVWMTGFGNFSYYYIKKDFSIARFAQMMWRLNFFVAFCCIVLDNDLMLYYICPMHTLFTLMVYGALGLFNKYNEIPSVMAIKIACCFLSVILIWEIPGVFELLWAPFTFLLGYKDPSPAKAHLPLLHEWHFRSGLDRYIWIIGMIYAYFHPNVERWMEKLEESETKVRLSIKGTIVTLSVMAGYLWYEYIYKLDKVTYNKYHPYTSWIPITAYICLRNCTQQLRSASLALFAWLGKITLETYISQIHIWLRSSMPNGQPKWLLCFIPDYPMLNFMLTTAIYLLLSYRVFEITNVLKGAFIPSRDNNRLYQNFVAGIAISVCLYFCSLILLKIPVV

SEQ ID NO: 3412 - protein, 540 aa, Oryza sativa
MEVFGPVTPGQVSFLLGLFPVLIGWIYAEILEYRKSLLYGKVHSDANLENETMKEDDKAVLLEGGQSKSPSTKLRNMSTKANLIRFITMDESFLLENRAVLRAMAEVGIILVYFYICDRTNIFPETKKSYNRDLFLFLYILLIIASALTSLKKHNEKSAFTGKSILYLNRHQTEEWKGWMQVLFLMYHYFAATEIYNAIRVFIAAYVWMTGFGNFSYYYIKKDFSIARFAQMMWRLNFFVAFCCIVLDNDYMLYYICPMHTLFTLMVYGSLGLFNKYNEKPSVMAIKIACCFLTVILIWEIPGVFEFLWAPFTFLLGYKDPEPSKANLPLLHEWHFRSGLDRYIWIIGMIYAYFHPNVERWMEKLEESETKVRLFIKGAIVTLSLTAGYLWYEYIYRLDKITYNKYHPYTSWIPITVYICLRNCTQQLRSASLALFAWLGKITLETYISQIHIWLRSSTPNGQPKWLLSFVPDYPLLNFMLTTAIYLLLSYRVFEITGVLKGAFIPSRDNNRLYQNFIAGIAISACLYFCSLILVKITIV

SEQ ID NO: 3413 - protein, 540 aa, Panicum virgatum
MEIFGPVTPGQVSFLLGLFPVLIAWIYSEILEYRKSLSHGKVHSDANLDNGTIKEDDKAVLLEGGQSKSPSTKFRNLSTKANLIRFITMDESFLLENRAVLRAMAEFGIVLVYFYICDRTNIFPESKKSYNRDLFLFLYILLIIASALTSLKKHHEKSAFTGKSILYLNRHQTEEWKGWMQVLFLMYHYFAASEIYNAIRVFIACYVWMTGFGNFSYYYIKKDFSIARFAQMMWRLNFFVAFCCIVLDNDLMLYYICPMHTLFTLMVYGSLGLFNKYNEIPSVMAIKIACCFLSVILIWEIPGVFELLWAPFTFLLGYKDPSPAKANLPLLHEWYFRSGLDRYIWIIGMIYAYFHPNVERWMEKLEESETKVRLSIKGTIVTLSLMTGYLWYEYIYKLDKVTYNKYHPYTSWIPITAYICLRNCTQQLRSASLALFAWLGKITLETYISQIHIWLRSSMPNGQPKWLLCFIPDYPMLNFMLTTAIYLLLSYRVFEITNVLKGAFIPSRDSNRLYQNFIAGIAISVCLYFCSLILLKIPIV

SEQ ID NO: 3414 - protein, 535 aa, Pennisetum glaucum
PVTPGQVSFLLGLFPVLIAWIYSEILEYRKSLSHGKVHSDANLDNGAIKEDDKTVLLEGGQLKSPSAKFRNLSTKANLIRFITMDESFLLENRAVLRAMAEFGIVLVYFYICDRTNIFPESKKSYNRDLFLFLYILLIIASALTSLKKHHDKSAFSGKSILYLNRHQTEEWKGWMQVLFLMYHYFAASEIYNAIRIFIACYVWMTGFGNFSYYYIKKDFSIARFAQMMWRLNFFVAFCCIVLDNDLMLYYICPMHTLFTLMVYGSLGLFNKYNERPSVMAIKIACCFLSVILIWEIPGVFELLWAPFTFLLGYKDPSPAKAHLPLLHEWHFRSGLDRYIWIIGMIYAYFHPNVERWMEKLEESETKVRLSIKGTIVTLSVMAGYLWYEYIYKLDKVTYNKYHPYTSWIPITVYICLRNCTQQLRSASLALFAWLGKITLETYISQIHIWLRSSTPNGQPKWLLCFIPDYPMLNFMLTTAIYLLLSYRVFEITNVLKGAFIPSRDNNRLYQNFVAGIAISVCLYFCSLILLKIPVV

SEQ ID NO: 3415 - protein, 540 aa, Sorghum bicolor
MEVFGPVTPGQVSFLLGLFPVLIAWIYSEILEYKKSLSHGKVHSDTNLDNGTIKEDDKSVLLEGGQLKSPSTKFRNLSTKANLLRFITMDESFLLENRAVLRAMAEFGVVLVYFYICDRTNIFPESKKSYNRDLFLFLYILLIIASALTSLKKHHEKSAFSGKSILYLNRHQTEEWKGWMQVLFLMYHYFAATEIYNAIRVFIACYVWMTGFGNFSYYYIKKDFSIARFAQMMWRLNFFVAFCCIVLDNDLMLYYICPMHTLFTLMVYGSLGLFNKYNEIPSIMAIKIACCFLSVILIWEIPGVFELLWAPFTFLLGYKDPSPSKAHLPLLHEWHFRSGLDRYIWIVGMIYAYFHPNVERWMEKLEESETKVRLSIKGTIVTLSLTAGFLWYEYIYKLDKVTYNKYHPYTSWIPITVYICLRNCTQQLRSASLALFAWLGKITLETYISQIHIWLRSNMPNGQPKWLLCFIPDYPMLNFMLTTAIYLLLSYRVFEITSVLRAAFIPSRDNSRLYQNFIAGIAISVCLYLCSLILLKIPVV

SEQ ID NO: 3416 - protein, 540 aa, Brachypodium distachyon
MEVFGPVTPGQVSFLLGLFPVLIAWTYAEILEYRKSLSHGKVHSDATLENETTKEDEKAILIEGGQLKSPSVKFRNMSTKANLIRFITMDESFLLENRAVLRAMAEFGVVLVYFYICDRTNIFPESKKNYNRDLFLFLYILLIIASALTSLKKHQEKSAFSGKSILYLNRHQTEEWKGWMQVLFLMYHYFAAFEIYNAIRVFIACYVWMTGFGNFSYYYIKKDFSIARFAQMMWRLNFFVAFCCIVLDNDFMLYYICPMHTLFTLMVYGSLGLFNKYNEVPSVMAIKIACCFLSVILIWEIPGVFEILWAPFTFLLGYKDPEPSKSNLPLLHEWHFRSGLDRYIWIIGMIYAYFHPNVERWMEKLEESETKVRLSIKGTIVTLSVMAAYLWYEYIYKLDKITYNKYHPYTSWIPITAYICLRNCTQQLRGASLALFAWLGKVTLETYISQIHIWLRSSIPNGQPKWLLSFIPDYPMLNFMLTTTIYLFLSYRVFELTNVLKNAFVPSRDNNRLYQNFIAGIAISVCLYCCSLILLKIPVV

SEQ ID NO: 3417 - protein, 540 aa, Triticum aestivum
MEVFGPVTPGQVSFLLGLFPVLIAWVYSEILEYKKSSLHGKVHSDATLENETSKEDEKAILIEGGQLKSPSAKFRNMSTKANLIRFITMDEPFLLENRAVLRAMAEFGIVLVYFYICDRTNIFPESKKNYNRDLFLFLYILLIIASALTSLKKHQEKSAFSGKSILYLNRHQTEEWKGWMQVLFLMYHYFGASEIYNAIRVFIACYVWMTGFGNFSYYYIKKDFSIARFAQMMWRLNFFVAFCCIVLDNDFMLYYICPMHTLFTLMVYASLGLFNKYNEIPSVMAIKIAGCFLAVILIWEVPGVFEILWAPFTFLLGYKDPEPSKSHLPLLHEWHFRSGLDRYIWIIGMIYAYFHPNVERWMEKLEESETKVRLSIKGTIVTLSVLAGYLWYEYIYRLDKITYNKYHPYTSWIPITVYICLRNCTQQLRGASLALFAWLGKVTLETYISQIHIWLRSSVPNGQPKWLLSFIPGYPMLNFMLTTSIYLLLSYRVFEITNVLRAAFIPSRDNNRLYQNFVAGVAISVCLYCCSLVLLKIPAV

SEQ ID NO: 3418 - protein, 540 aa, Hordeum vulgare
MEVFGPVTPGQVSFLLGLFPVLIAWVYSEILEYKKSSLHGKVHSDATLENETSKEDEKAILIEGGQLKSPSAKFRNMSTKANLIRFITMDEPFLLENRAVLRAMAEFGIVLVYFYICDRTNIFPESKKNYNRDLFLFLYILLIIASALTSLKKHQEKSAFSGKSILYLNRHQTEEWKGWMQVLFLMYHYFGASEIYNAIRVFIACYVWMTGFGNFSYYYIKKDFSIARFAQMMWRLNFFVAFCCIVLDNDFMLYYICPMHTLFTLMVYASLGLFNKYNEIPSVMAIKIAGCFLAVILIWEVPGVFEILWAPFTFLLGYKDPEPSKSHLPLLHEWHFRSGLDRYIWIIGMIYAYFHPNVERWMEKLEESETKVRLSIKGTIVTVSVVAGYLWYEYIYRLDKITYNKYHPYTSWIPITVYICLRNCTQQLRGASMALFAWLGKVTLETYISQIHIWLRSSVPNGQPKWLLSFIPGYPMLNFMLTTSIYLLLSYRVFEITNVLRAAFIPSRDNNRLYQNFIAGVAISVCLYCCSLVLLKIPAV

SEQ ID NO: 3419 - protein, 540 aa, Secale cereale
MEVFGPVTPGQVSFLLGLFPVLIAWVYSEILEYKKSSLHGKVHSDATLENETSKEDEKAILIEGGQLKSPSAKFRNMSTKANLIRFITMDEPFLLENRAVLRAMAEFGIVLVYFYICDRTNIFPESKKNYNRDLFLFLYILLIIASALTSLKKHQEKSAFSGKSILYLNRHQTEEWKGWMQVLFLMYHYFGASEIYNAIRVFIACYVWMTGFGNFSYYYIKKDFSIARFAQMMWRLNFFVAFCCIVLDNDFMLYYICPMHTLFTLMVYASLGLFNKYNEIPSVMAIKIAGCFLAVILIWEVPGVFEILWAPFTFLLGYKDPEPSKSHLPLLHEWHFRSGLDRYIWIVGMIYAYFHPNVEKWMEKLEESETKVRLSIKGTIVTLSVLAGYLWYEYIYRLDKITYNKYHPYTSWIPITVYICLRNCTQQLRGASLALFAWLGKVTLETYISQIHIWLRSSVPNGQPKWLLSFIPGYPMLNFMLTTSIYLLLSYRVFEITNVLRAAFIPSRDNNRLYQNFVAGVAISVCLYCCSLVLLKIPAV

SEQ ID NO: 3420 - protein, 539 aa, Triticum aestivum
EVFGPVTPGQVSFLLGLFPVLIAWVYSEILEYKKSSLHGKVHSDATLENETSKEDEKAILIEGGQLKSPSAKFRNMSTKANLIRFITMDEPFLLENRAVLRAMAEFGIVLVYFYICDRTNIFPESKKNYNRDLFLFLYILLIIASALTSLKKHQEKSAFSGKSILYLNRHQTEEWKGWMQVLFLMYHYFGASEIYNAIRVFIACYVWMTGFGNFSYYYIKKDFSIARFAQMMWRLNFFVAFCCIVLDNDFMLYYICPMHTLFTLMVYASLGLFNKYNEIPSVMAIKIAGCFLAVILIWEVPGVFEILWAPFTFLLGYKDPEPSKSHLPLLHEWHFRSGLDRYIWIVGMIYAYFHPNVERWMEKLEESETKVRLSIKGTIVTLSVLAGYLWYEYIYRLDKITYNKYHPYTSWIPITVYICLRNCTQQLRGASLALFAWLGKVTLETYISQIHIWLRSSVPNGQPKWLLSFIPGYPMLNFMLTTSIYLLLSYRVFEITNVLRAAFIPSRDNNRLYQNFVAGVVISVCLYCCSLVLLKIPAV

SEQ ID NO: 3421 - protein, 540 aa, Secale cereale
MEVFGPVTPGQVSFLLGLFPVLIAWVYSEILEYKKSSLHGKVHSDATLENETSKEDEKAILIEGGQLKSPSAKFRNMSTKANLIRFITMDEPFLLENRAVLRAMAEFGIVLVYFYICDRTNIFPESKKNYNRDLFLFLYILLIIASALTSLKKHQEKSAFSGKSILYLNRHQTEEWKGWMQVLFLMYHYFGASEIYNAIRVFIACYVWMTGFGNFSYYYIKKDFSIARFAQMMWRLNFFVAFCCIVLDNDFMLYYICPMHTLFTLMVYASLGLFNKYNEIPSVMAIKIAGCFLAVILIWEVPGVFEILWAPFTFLLGYKDPEPSKSHLPLLHEWHFRSGLDRYIWIVGMIYAYFHPNVEKWMEKLEESETKVRLSIKGTIVTLSVLAGYLWYEYIYRLDKITYNKYHPYTSWIPITVYICLRNCTQQLRGASLALFAWLGKVTLETYISQIHIWLRSSVPNGQPKWLLSFIPGYPMLNFMLTTSIYLLLSYRVFEITNVLRAAFIPSRDNNRLYQNFIAGVAISVCLYCCSLVLLKIPAV

SEQ ID NO: 3422 - protein, 540 aa, Secale cereale
MEVFGPVTPGQVSFLLGLFPVLIAWVYSEVLEYKKSSLHGKVHSDATLENETSKEDEKAILIEGGQLKSPSAKFRNMSTKANLIRFITMDEPFLLENRAVLRAMAEFGIVLVYFYICDRTNIFPESKKNYNRDLFLFLYILLIIASALTSLKKHQEKSAFSGKSILYLNRHQTEEWKGWMQVLFLMYHYFGASEIYNAIRVFIACYVWMTGFGNFSYYYIKKDFSIARFAQMMWRLNFFVAFCCIVLDNDFMLYYICPMHTLFTLMVYASLGLFNKYNEIPSVMAIKIAGCFLAVILIWEVPGVFEILWAPFTFLLGYKDPEPSKSHLPLLHEWHFRSGLDRYIWIVGMIYAYFHPNVEKWMEKLEESETKVRLSIKGTIVTLSVLAGYLWYEYIYRLDKITYNKYHPYTSWIPITVYICLRNCTQQLRGASLALFAWLGKVTLETYISQIHIWLRSSVPNGQPKWLLSFIPGYPMLNFMLTTSIYLLLSYRVFEITNVLRAAFIPSRDNNRLYQNFVAGVAISVCLYCCSLVLLKIPAV

SEQ ID NO: 3423 - protein, 534 aa, Triticum aestivum
VTPGQVSFLLGLFPVLIAWVYSEILEYKKSSLHGKVHSDATLENETSKEDEKAILIEGGQLKSPSAKFRNMSTKANLIRFITMDEPFLLENRAVLRAMAEFGIVLVYFYICDRTNIFPESKKNYNRDLFLFLYILLIIASALTSLKKHQEKSAFSGKSILYLNRHQTEEWKGWMQVLFLMYHYFGASEIYNAIRVFIACYVWMTGFGNFSYYYIKKDFSIARFAQMMWRLNFFVAFCCIVLDNDFMLYYICPMHTLFTLMVYASLGLFNKYNEIPSVMAIKIAGCFLAVILIWEVPGVFEILWAPFTFLLGYKDPEPSKSHLPLLHEWHFRSGLDRYIWIIGMIYAYFHPNVERWMEKLEESETKVRLSIKGTIVTLSVLAGYLWYEYIYRLDKITYNKYHPYTSWIPITVYICLRNCTQQLRGASLALFAWLGKVTLETYISQIHIWLRSSVPNGQPKWLLSFIPGYPMLNFMLTTSIYLLLSYRVFEITNVLRAAFIPSRDNNRLYQNFVAGVAISVCLYCCSLVLLKIPAV

SEQ ID NO: 3424 - protein, 208 aa, Secale cereale
MEVFGPVTPGQVSFLLGLFPVLIAWVYSEILEYKKSSLHGKVHSDATLENETSKEDEKAILIEGGQLKSPSAKFRNMSTKANLIRFITMDEPFLLENRAVLRAMAEFGIVLVYFYICDRTNIFPESKKNYNRDLFLFLYILLIIASALTSLKKHQEKSAFSGKSILYLNRHQTEEWKGWMQVLFLMYHYFGASEIYNAIRVSLLAMFG

SEQ ID NO: 3425 - protein, 355 aa, Secale cereale
MQVLFLMYHYFGASEIYNAIRVFIACYVWMTGFGNFSYYYIKKDFSIARFAQMMWRLNFFVAFCCIVLDNDFMLYYICPMHTLFTLMVYASLGLFNKYNEIPSVMAIKIAGCFLAVILIWEVPGVFEILWAPFTFLLGYKDPEPSKSHLPLLHEWHFRSGLDRYIWIVGMIYAYFHPNVEKWMEKLEESETKVRLSIKGTIVTLSVLAGYLWYEYIYRLDKITYNKYHPYTSWIPITVYICLRNCTQQLRGASLALFAWLGKVTLETYISQIHIWLRSSVPNGQPKWLLSFIPGYPMLNFMLTTSIYLLLSYRVFEITNVLRAAFIPSRDNNRLYQNFVAGSPSPCACTAAHSFF

SEQ ID NO: 3426 - protein, 540 aa, Secale cereale
MEVFGPVTPGQVSFLLGLFPVLIAWVYSEILEYKKSSLHGKVHSDATLENETSKEDEKAILIEGGQLKSPSAKFRNMSTKANLIRFITMDEPFLLENRAVLRAMAEFGIVLVYFYICDRTNIFPESKKNYNRDLFLFLYILLIIASALTSLKKHQEKSAFSGKSILYLNRHQTEEWKGWMQVLFLMYHYFGASEIYNAIRVFIACYVWMTGFGNFSYYYIKKDFSIARFAQMMWRLNFFVAFCCIVLDNDFMLYYICPMHTLFTLMVYASLGLFNKYNEIPSVMAIKIAGCFLAVILIWEVPGVFEILWAPFSFCLAIKIQSLLSHTLPLLHEWHFRSGLDRYIWIVGMIYAYFHPNVEKWMEKLEESETKVRLSIKGTIVTLSVLAGYLWYEYIYRLDKITYNKYHPYTSWIPITVYICLRNCTQQLRGASLALFAWLGKVTLETYISQIHIWLRSSVPNGQPKWLLSFIPGYPMLNFMLTTSIYLLLSYRVFEITNVLRAAFIPSRDNNRLYQNFVAGVAISVCLYCCSLVLLKIPAV

SEQ ID NO: 3427 - protein, 529 aa, Avena sativa
VSFLLGLFPVLIAWVYAEILEYRRSSSYGKVHSDAALENETLKDDEKAILIEGGQLKSPSAKFRNMSTKANLIRFITMDESFLLENRAVLRAMAEVGIVLVYYYICDRTNIFAESKKNYNRDLFLFLYILLIIASALTSLKKHQEKSAFSGKSILYLNRHQTEEWKGWMQVLFLMYHYFGASEIYNAIRVFIACYVWMTGFGNFSYYYIKKDFSIARFAQMMWRLNFFVAFCCIVLDNDFMLYYICPMHTLFTLMVYGSLGLFNKYNEIPSVMAIKIACCFLSVILIWEVPGVFEILWAPFTFLLGYKDPEPSKSHLPLLHEWHFRSGLDRYIWIIGMIYAYFHPNVERWMEKLEESETKVRLSIKGTIVTVSVLAGYLWYEYIYKLDKITYNKYHPYTSWIPITVYICLRNCTQQLRGASLALFGWLGKVTLETYISQIHIWLRSSVPNGQPKWLLCFIPEYPMLNFMLTTTIYLFLSYRIFELTNVLRAAFIPSRDNNRLYHNFVAGVVISVCLYFCSLVLLKIPGV

SEQ ID NO: 3428 - protein, 117 aa, Triticum aestivum
VYSEILEYKKSSLHGKVHSDATLENETSKEDEKAILIEGGQLKSPSAKFRNMSTKANLIRFITMDEPFLLENRAVLRAMAEFGIVLVYFYIWTDKHISREQEELQQRPVLFCTFFSS

SEQ ID NO: 3429 - protein, 79 aa, Panicum virgatum
MRFSREDLVGSVFIAFGVTLFVGFFYAAIVSKLLPPYENSLLAAIQNDWYYCLLVPLTLPVIIVAVYLHWLSMKMFKHA

SEQ ID NO: 3430 - protein, 79 aa, Pennisetum glaucum
MHFFKGDLVGSAFMAFGITLFVGFFYAAVLSKLLPPYENKLLAGIQNDWYYCLLVPLTLPVITVAVYLHWLSMKMFKHA

SEQ ID NO: 3431 - protein, 79 aa, Panicum virgatum
MHFLREDLVGSVFIAFGVTLFVGFFYAAVVSKLLPPYENSLFAAIQNDWYYCLLVPLTLPVIIVAVYLHWLSMKMFKHA

SEQ ID NO: 3432 - protein, 79 aa, Brachypodium distachyon
MRFSREQLVGSAFVAFGILLFVGFFYAAVVSKLLPPYENRLLSAIQNDRYYCLLVPLTLPVIIVAVYLHWLSMKMFKHA

SEQ ID NO: 3433 - protein, 75 aa, Panicum virgatum
REDLVGSVFIAFGVTLFVGFFYAAIVSKLLPPYENSLLAAIQNDWYYCLLVPLTLPVIIVAVYLHWLSMKMFKHA

SEQ ID NO: 3434 - protein, 78 aa, Panicum virgatum
MFKHLHTKPMQIDCHDYHRKRQWHKNSLPIILDGSEKTVFIWWKQLGHDGSIEETHKQSDPKSNEHRPNQIFSQKMHL

SEQ ID NO: 3435 - protein, 80 aa, Triticum aestivum
MIHFSRDQLMGSAFVAFGIILFVGFFYAAVVSKMLPPYENWLLAAIQNDRYYCLLVPLTLPVIIVAVYLHWLSMKMFKHA

SEQ ID NO: 3436 - protein, 79 aa, Zea mays
MHFSTDQLIGSAFIAFGLTLFVCFFYVAVVSKLLPPHQNGFLAAIQNDWYYCLLVPLTLPVIIVAVYLHWLSMKMFKHA

SEQ ID NO: 3437 - protein, 351 aa, Panicum virgatum
MQEGHGETVNYRVFAGTWNVGGKAPPDDLDLEDWLDTKAGSHDIYVLGFQEMVPLNVRSVLGPKQRSAAMNWQRLIGDALNGGRRSVMDGEDAAMDHGQGAFRCVMSKQMVGIFVAVWTRSGLRRHVRHPGVSAVGAGVLGRLGNKGAVSVRFLLHGTSFCFVCCHLASGGGGGDALRRNADAAYILARTSFLNSGGAPAPAPEELPRKILDHDRVVLLGDLNYRIAMDDAEARQLVRARKWSMLLENDELLLELAEGRRFDGWREGHVTFAPTYKYHRNSDQFCWCADGGAAAGRGKQHRAPAWCDRILWRGKGMRQIRYEWCGGYRLSDHRPVRAVFHAVCEVVETKAC

SEQ ID NO: 3438 - protein, 351 aa, Panicum virgatum
MQEGHGETVNYRVFAGTWNVGGEAPPDDLDLEDWLDTKAGSHDIYVLGFQEMVPLNARSVLGPKQRSAAMKWQRLIGDALNGGRRSVMDGEDAAMDHGQGAFRCVMSKQMVGIFVSVWTRSGLRRHVRHPGVSAVGAGVLGRLGNKGAVSVRFLLHGTSFCFVCCHLASGGGDGDALRRNADAAYILARTSFLNSGGAPAPAPEELPRKILDHDRVVLLGDLNYRIAMDDAEARQLVRARKWSMLLENDELLLELAEGRRFDGWREGHVTFAPTYKYHRNSDQFCWCADGGAAAGRGKQHRAPAWCDRILWRGKGMRQIRYEWCGGYRLSDHRPVRAVFHAVCEVVETKAC

SEQ ID NO: 3439 - protein, 515 aa, Sorghum bicolor
MSSNSSLTESLHEKTIVFGLKLWVVIGIAVGASLLGILLILLICLTIQSCIKRSRKPLKDRRMHQIPPAYKDIKEVGMVDQFPANDFVVHDGLLLTIQNEPEPVESVDRDAIQLAQEEKLKQREENNVSGSFPITDGCEGNQIVSADEQSSTHATIDSAPLAGLPEFSYLGWGHWFTLRDLELATNRFAKDNVIGEGGYGVVYRGRLSNGTPVAVKKILNNLGQAEREFRVEVEAIGHVRHKNLVRLLGYCVEGTQRMLVYEYVNNGNLESWLHGELSQYSSLTWLARMKILLGTAKALAYLHEAIEPKVVHRDIKSSNILIDDEFNAKISDFGLAKMLGAGKSHIATRVMGTFGYVAPEYANSGLLNEKSDVYSFGVVLLEAITGRDPIDYDRPTNEVNLVDWLKMMVANRRSEEVVDPNLERRPSTKELKRALLTALRCIDLNAEKRPSMDQVVRMLDSNEPIPQEERRHRQNRIPESSETEPLRGKNNSGRSDAPEHEARPPRPKSRTFSSK

SEQ ID NO: 3440 - protein, 508 aa, Panicum virgatum
MSSNSSLTESLHEKTIVFGLKLWVVIGIAVGASLLGILLILLICLTIQSCIRRSRKPLHDRPMTQIPPPCKDIKEVSNDFVVHDGLLLTIQNEPEHGDLVDREAIQLAQEEKLKQGEENNLSGSFRITDGCDGIQIASLDEQSSTHATVDSAPLVGLPEFSYLGWGHWFTLRDLELATNRFAKDNVIGEGGYGVVYRGRLSNGTPVAVKKILNNLGQAEREFRVEVEAIGHVRHKNLVRLLGYCVEGTQRMLVYEYVNNGNLESWLHGELSQYSSLTWLARMKILLGTAKALAYLHEAIEPKVVHRDIKSSNILIDDEFNAKISDFGLAKMLGAGKSHIATRVMGTFGYVAPEYANSGLLNEKSDVYSFGVVLLEAITGRDPIDYERPPNEVNLVDWLKMMVANRRSEEVVDPNLERRPSTKELKRALLTALRCIDLNAEKRPSMDQVVRMLDSNEPIPQEERRHRQNRTPESSETEPLRGKNNSGRSDAPEHEARPPRPKSRTFSSK

SEQ ID NO: 3441 - protein, 515 aa, Zea mays
MSSDSSLTESLHERTIVFGLKLWVVIGIAVGASLLGILLILLICLTIQSCIKRSRKPLNDRRLHQIPPAYKDIKEVGMVDQFPAKDFVVHDGLLLTIQNGPEPVEPVDRDAIQLAQEEKLKQREETNVSASFPIMDGCEGTQIVSVDEQSSTHATVDSAPLAGLPEFSYLGWGHWFTLRDLDLATDHFAKDNVIGEGGYGVVYRGRLSNGTPVAVKKILNNLGQAEREFRVEVEAIGHVRHKNLVRLLGYCVEGTQRMLVYEYVNNGNLESWLHGELSQYSSLTWLARMKILLGTAKALAYLHEAIEPKVVHRDIKSSNILIDDEFNAKISDFGLAKMLGAGKSHIATRVMGTFGYVAPEYANSGLLNEKSDVYSFGVVLLEAITGRDPIDYDRPTNEVNLVDWLKMMVANRRSEQVVDPNLERRPSTKELKRALLTALRCIDLNAEKRPSMDQVVRMLDSNELIPQEERRHRQIRIPESSETEPLRGKNNSGRSDAPEHEARPPRPKSRTFSSK

SEQ ID NO: 3442 - protein, 460 aa, Pennisetum glaucum
KPLNDRPIIQIPPAYKDIKEVGTVDQFSANDFVVHDGLLLTIQNEPEPVESVDRDAVQLAQEEKLKQREEKNLSGSFRITDGCDVIQIVSAEEQSSTNATVDSAPLAGLPEFSYLGWGHWFTLRDLELATNRFAKDNVIGEGGYGVVYRGRLSNGTPVAVKKILNNLGQAEREFRVEVEAIGHVRHKNLVRLLGYCVEGIQRMLVYEYVNNGNLESWLHGELSQYSSLTWLARMKILLGTAKALAYLHEAIEPKVVHRDIKSSNILIDDEFNAKISDFGLAKMLGAGKSHIATRVMGTFGYVAPEYANSGLLNEKSDVYSFGVVLLEAITGRDPIDYERPPNEVNLVDWLKMMVANRRSEEVVDPNLERRPSTKELKRALLTALRCIDLNAEKRPSMDQVVRMLDSNEPIPQEERRHRQNRAPETSETEPLRGKNNSGRSDAPEHEARPPRPKSRTFSSK

SEQ ID NO: 3443 - protein, 513 aa, Triticum aestivum
MSSNSTLTESLHEKTIVFGLKLWVVIGIAVGASLLGILLILVICLTIQTWIRRSRKAFKELPMTQIPSAFKDITEVRVADQFSSNDYVVHDGLLLAIENGPVESMDKDAVQLVQEDNSRHREENNLSGSLVHTDGCDGIQSVSVCEQPSVHATADSAPLDGLPEFSYLGWGHWFTLRDLDVATDHFAKDNVIGEGGYGVVYRGRLSNGTPVAVKKILNNLGQAEREFRVEVEAIGNVRHKNLVRLLGYCVEGTQRMLVYEFVNNGNLESWLHGELSQYSSLTWLARMKVLLGTAKALAYLHEALEPKVVHRDIKASNILIDDEFNAKISDFGLAKMLGAGKSHIATRVMGTFGYVAPEYANSGLLNEKSDVYSFGVLLLEVITGRDPIDYDRPPSEVNLVDWLKLMVANRRSDEVVDPHLERRPSTKELKRALLTALRCIDLNAEKRPRMDQVVRMLDSSETIPQEERRPRQNRISENTETVPLRGKNSIEKSDAPEHEERPPRPKSRPFSSK

SEQ ID NO: 3444 - protein, 513 aa, Triticum aestivum
MSSNSTLTESLHEKTIVFGLKLWVVIGIAVGASLLGILLILVICLTIQTWIRRSRRAFKELPMTQIPSAFKDITEVRVADQFSPNDYVVHDGLLLAIENGPVESTDKDAVQSAQEDNSRHREENNLSGSLVHTDGCDGIQSVSVCEQPSVHATADSAPLDGLPEFSYLGWGHWFTLRDLDVATDHFAKDNVIGEGGYGVVYRGRLSNGTPVAVKKILNNLGQAEREFRVEVEAIGNVRHKNLVRLLGYCVEGTQRMLVYEFVNNGNLESWLHGELSQYSSLTWLARMKVLLGTAKALAYLHEALEPKVVHRDIKASNILIDDEFNAKISDFGLAKMLGAGKSHIATRVMGTFGYVAPEYANSGLLNEKSDVYSFGVLLLEVITGRDPIDYDRPPSEVNLVDWLKLMVANRRSDEVVDPHLERRPSTKELKRALLTALRCIDLNAEKRPRMDQVVRMLDSSETIPQEERRPRQNRISENTETVPLRGKNSIEKSDAPEHEERPPRPKSRPFSSK

SEQ ID NO: 3445 - protein, 513 aa, Secale cereale
MSSNSTLTESLHEKTIVFGLKLWVVIGIAVGASLLGILLILVICLTIQSWVRRSRRAFKELPMTQIPSAFKDITEVRVADQFSPNDYVVHDGLLLAIENGPVESTDKDAVQSAQEDNSRHREENNLSGSLVHTDDCDGIQSVSVCEQPSVHATADSAPLDGLPEFSYLGWGHWFTLRDLDVATDHFAKDNVIGEGGYGVVYRGRLSNGTPVAVKKILNNLGQAEREFRVEVEAIGNVRHKNLVRLLGYCVEGTQRMLVYEFVNNGNLESWLHGELSQYSSLTWLARMKVLLGTAKALAYLHEALEPKVVHRDIKASNILIDDEFNAKISDFGLAKMLGAGKSHIATRVMGTFGYVAPEYANSGLLNEKSDVYSFGVLLLEVITGRDPIDYDRPPSEVNLVDWLKLMVANRRSEEVVDPHLERRPSTKELKRALLTALRCIDLNAEKRPRMDQVVRMLDSSETIPQEERRPRQNRISENTETVPLRGKNSIEKSDAPEHEERPPRSKSRPFSSK

SEQ ID NO: 3446 - protein, 513 aa, Triticum aestivum
MSSNSTLTESLHEKTIVFGLKLWVVIGIAVGASLLGILLILVICLTIQTWIRRSRRAFKELPMTQIPSAFKDITEVRVADQFSPNDYVVHDGLLLAIENGPVESTDKDAVQSAQEDNSRHREENNLSGSLVHTDGCDGIQSVSVCEQPSVHATADSAPLDGLPEFSYLGWGHWFTLRDLDVATDHFAKDNVIGEGGYGVVYRGRLSNGTPVAVKKILNNLGQAEREFRVEVEAIGNVRHKNLVRLLGYCVEGTQRMLVYEFVNNGNLESWLHGELSQYSSLTWLARMKVLLGTAKALAYLHEALEPKVVHRDIKASNILIDDEFNAKISDFGLAKMLGAGKSHIATRVMGTFGYVAPEYANSGLLNEKSDVYSFGVLLLEVITGRDPIDYDRPPSEVNLVDWLKLMVANRRSDEVVDPHLERRPSTKELKRALLTALRCIDLNAEKRPRMDQVVRMLDSSETIPQEERRPRQNRISENTETVPLRGKNSIEKSDAPEHEERPPRSKTRPFSSK

SEQ ID NO: 3447 - protein, 515 aa, Brachypodium distachyon
MSSNSTLTESLHEKTIVFGLKLWVVIGIAVGASLLGILLILVICLTIQSWVKRSRRAFKELPMTQIPSACKDITEVRVADQFSPNDFVVHDGLLLAIENGPVESADKDAVQLSEEDNLRHREDNNNLLGGTFCHADGCDGIQSVSVCEQPSAHAAADSAPLAGLPEFSYLGWGHWFTLRDLDVATNHFSKDNVIGEGGYGVVYRGRLSNGTPVAVKKILNNLGQAEREFRVEVEAIGNVRHKNLVRLLGYCVEGTQRMLVYEFVNNGNLESWLHGELSQYSSLTWLARMKVLLGTAKALAYLHEALEPKVVHRDIKASNILIDDEFNAKISDFGLAKMLGAGKSHIATRVMGTFGYVAPEYANSGLLNEKSDVYSFGVLLLEVITGRDPIDYDRPPSEVNLVDWLKVMVANRRSEEVVDPHLERRPSTKELKRALLTALRCIDLNAEKRPRMDQVVRMLDSSETIPQEERRQRPNRMPDNTETMPLRGKNSTDNSDAPEREERPPRPKSRTFSTK

SEQ ID NO: 3448 - protein, 512 aa, Oryza sativa
MSSNSTLTDSLHERTIVFGLKLWVVIGISVGASLLGVLLILIVCLTLQTWIKRSRRTFKEIPITQIPSASKDIKEVRAVDEFLPNDFVVHDGLLLAIQNEPVEPVDKDVNQFAQEDKTIQGEENSPVPLHYVDNYDVIQSVSTCEQSSSHAPVDSVLLPGLPEFSYLGWGHWFTLRDLELATNCFSKDNVIGEGGYGVVYRGRLSNGTPVAVKKILNNLGQAEREFRVEVEAIGHVRHKNLVRLLGYCVEGTQRMLVYEYVNNGNLESWLHGELSQYSSLTWLARMKILLGTAKALAYLHEAIEPKVVHRDIKASNILIDDEFNAKISDFGLAKMLGAGKSHIATRVMGTFGYVAPEYANSGLLNEKSDVYSFGVVLLEAITGRDPIDYDRPTDEVNLVDWLKMMVAHRRSEEVVDPNLERRPSTKELKRALLTALRCIDLNAEKRPRMDQVVRMLDSNEPIPQEERRQRQNHISNNSETEPLRGKSSSGKSDAPENEMRPPRYKNRSFPPK

SEQ ID NO: 3449 - protein, 513 aa, Oryza sativa
MSSNSTLTDSLHERTIVFGLKLWVVIGISVGASLLGVLLILIVCLTIQTWIKRSRRTFKEIPITQIPSASKDIKEVRAVEEFLPNDFVVHDGLLLAIQNEPVEPVDKDVNQFAQEDKTIQGEDNSSSVPLHYVDNYDGIQSVSTCEQSSSHAPADSVPLPGLPEFSYLGWGHWFTLRDLELATNCFSKDNVIGEGGYGVVYRGRLSNGTPVAVKKILNNLGQAEREFRVEVEAIGHVRHKNLVRLLGYCVEGTQRMLVYEYVNNGNLESWLHGELSQYSSLTWLARMKILLGTAKALAYLHEAIEPKVVHRDIKASNILIDDEFNAKISDFGLAKMLGAGKSHIATRVMGTFGYVAPEYANSGLLNEKSDVYSFGVVLLEAITGRDPIDYDRPPDEVNLVDWLKMMVANRRSEEVVDPNLERRPSTKELKRALLTALRCIDLNSEKRPRMDQVVRMLDSNEPIPQEERRQRQNHISNNSETEPLRGKSSSGKSDAPENEMRPPRYKNRSFPPK

SEQ ID NO: 3450 - protein, 218 aa, Pennisetum glaucum
MAGRMVRSCVQTALKAANSVVGLAGMAVILYALWMLRAWYREVAQLHQRLPVPWFIYTFLGMGIFLCLLTCSGHIAAETANGHCLSCYMIIVFVLIILEGAITVDVFLNNNWEEDFPPDPSGKFDEFKVFVISNSEICEWVGLSVVAAQVLSIILGMVLRTLGPDRETDYDSDDDITVPARLPLLRNQSQHGPTDYAEPNTSRGSDSWKLRILDKVNN

SEQ ID NO: 3451 - protein, 217 aa, Panicum virgatum
MAGRIVRSCVQTALKAVNSVVGLAGMAVILYALWMLRAWYREVADLDQRFPVPWFIYTFLGLGIFLCLLTCSGHIAAETANGHCLSCYMIIVFVLIILEGAITVDVFLNTNWEEDFPPDPSGKFDEFKDFVRSNFEICEWVGLSVVAAQVLSIILGMVLRTLGPDREADYDSDDDTTVPARLPLLRNQSQHGPDYAEPNTSRRSDSWKLRILDKVNN

SEQ ID NO: 3452 - protein, 217 aa, Panicum virgatum
MAGRMVRSCVQTALKAANSVVGLAGMAVILYALWMLRAWYREVADLDQRFPVPWFIYTFLGLGIFMCLLTCSGHIAAETANGHCLSCYMIIVFVLIILEGAITMDVFLNTNWEEDFPPDPSGKFDEFKDFVRSNFEICECVGLSVVAAQVLSIILGMVLRTLGPDREADYDSDDDTTVPARLPLLRNQSQHGPDYAEPNTSRRSDSWKLRILDKVNN

SEQ ID NO: 3453 - protein, 219 aa, Sorghum bicolor
MAGRMVRSCVQTALKAANSVVGLAGMAVILYALWMLRAWYREVADHHLHQRLPVPWFIYAFLGLGIFLCLLTCSGHIAAETANGHCLSCYMIIVFVLIILEGTITMDVCLNSNWEEDFPPDPSGKFEDFKDFVKSNFEICEWVGLSVVAAQVLSIILGMVLRTLGPERETDYDSDDDTIVPARLPLLRNQAQHGLDYAEPNTSRRSDSWKLRILDKVNN

SEQ ID NO: 3454 - protein, 217 aa, Zea mays
MAGRMVRSCVQTALKAANSVVGLAGMAVILYALWMLRAWYREVADLQQHLPVPWCIYTFLGLGIFLCLLTCSGHIAAETANGHCLSCYMTIVFVLIMLEGAITMDVFLNSNWEEDFPADPSGKFEDFKHFVRSNFEICEWVGLSVVAAQVLSIILGMVLRTLGPDRETDYDSDDDVTVPARLPLLINQSQHGSYYAEPNTSGRSDSWKLRILDKVNN

SEQ ID NO: 3455 - protein, 371 aa, Panicum virgatum
MKGGDVSSISPLVSFVLGAAMATVCVLFFMSASPTRRLADISAFSSGNATSSDLRLASSDSDNGVVADGDAEVTATPAPAPAPVQAESPWGDLEEVLRRAATKDRTVIMTQINAAWTRPGSLLDLFFESFRSGEGGVARLLEHLVIVTMDPAAYQGCQAVHRHCYFLRTSNGVDYRSEKMFMSKDYLEMMWGRNRFQQTVLELGYNFLFTDVDVMWFRDPFRHISMAADIAISSDVYMGDPYSLRNFPNGGFLFVRSSAKTIDFYRAWQQGRWRFFGKHEQDVFNLIKHDMAAKLDLAIQFLDTTYISGFCQLSKDLNKICTLHANCCVGLGAKLHDLRGVLDVWRNYTAGTPQDRRAGKFQWKLPGICIH

SEQ ID NO: 3456 - protein, 366 aa, Zea mays
MKGGDMSSVSPLVSFVLGAAMATVCVLFFMSAAPARRLVDISAFTSNSNSTADLLLDSSDSPAAADLAEAAPPAPAPVQAPPSPWGDLEEVLARAATKDRTVIMTQINAAWTRPGSLLDLFFESFRTGEGGVARLLDHLVIVTMDPAAYEGCRAVHSHCYFLRTGNGVDYRSEKVFMSKDYLEMMWGRNRFQQTVLELGYNFLFTDVDVMWFRDPFRHISMAADIAISSDVYMGDPYSLRNFPNGGFLFVRASDKTVAFYRAWQQGRWRFLGKHEQDVFNLIKHEEAPRLDLAIQFLDTAYISGFCQLSKDLNRICTLHANCCVGLGAKLHDLRGVLDVWRNYTAGTPEERRAGKFQWKLPGICIH

SEQ ID NO: 3457 - protein, 371 aa, Sorghum bicolor
MKGGDMSSVSPLVSFVLGAAMATVCVLFFMSATPARRLVDISAFTSAAPDNLTGIASSVSDSDSDAAVADSAAALASTATLAPAPAPSPWGDLEEVLARAATKDRTVIMTQINAAWTRPGSLLDLFFESFRTGEGGVARLLDHLVIVTMDPAAYEGCKAVHRHCYFLRTSNGVDYRSEKMFMSKDYLEMMWGRNRFQQTVLELGYNFLFTDVDVMWFRDPFRHISMAADIAISSDVYIGDPYSLRNFPNGGFLFVRSSAKTIDFYRAWQQGRWRFLGKHEQDVFNLIKHEMAPKLDLAIQFLDTAYISGFCQLSKDLNKICTLHANCCVGLGAKLHDLRGVLDVWRNYTAGTPDERRAGKFQWKLPGICIH

SEQ ID NO: 3458 - protein, 349 aa, Saccharum officinarum
MKGGDMSSVSPLVSFVLGAAMATVCVLFFMSATPARRLVDISAFTSAAAPEDLQRLASDDSAATATPAPAPAPVQPPSPWGDLEEVLARAATKDRTVIMTQINAAWTRPGSLLDLFFESFRTGEDGVARLLDHLVIVTMDPAAYEGCKAVHRHCYFLRTSNGVDYRSEKMFMSKDYLEMMWGRNRFQQTVLQLGYNFLFTDVDVMWFRDPFRHISMAADIAISSDVFIGDPYSLRNFPNGGFLFVRSSAKTIDFYRAWQQGRWRFLGKHEQDVFNLIKHEMAPKLDLAIQFLDTAYISGFCQLSKDLNKICTLHANCCVGLGAKLHDLRGVLDVWRNYTAGTPDERRAG

SEQ ID NO: 3459 - protein, 379 aa, Oryza sativa
MGGGGGSGSSSISPLVSFVLGAAMATVCILFVMSASPGRRLADISAWSNADDAPPLPLPLQDAAVDSNDSLAAAAAANVTVVAAPAPAPVQAPAPASPYGDLEEVLRRAATKDRTVIMTQINLAWTKPGSLLDLFFESFRLGEGGVSRLLDHLVIVTMDPAAYEGCQAVHRHCYFLRTTGVDYRSEKMFMSKDYLEMMWGRNKFQQTILELGYNFLFTDVDVMWFRDPFRHISMGADIAISSDVFIGDPYSLGNFPNGGFLFVRSNDKTLDFYRSWQQGRWRFFGKHEQDVFNLIKHEQQAKLGIAIQFLDTTYISGFCQLSKDLNKICTLHANCCVGLGAKMHDLRGVLDVWRNYTAAPPDERRSGKFQWKLPGICIH

SEQ ID NO: 3460 - protein, 120 aa, Setaria italica
GLPHPEHFPFCDQEDETIQHLLCSCVFSRQFWLQLLRSFGLLDIAPQPSSTGFFDWWQQAGSTLDKGTKRGFNSPVMLGAWILWKERNDIVFNGASPRMERVLLLAQEEAVLWRLVGAKG

SEQ ID NO: 3461 - protein, 114 aa, Setaria italica
MKPFSTSSILVSSLGNSGFNYFAVLDSQILHLNHLPLGWWQQAGSTLDKGTKRGFNSLVMLGAWILWKERNDIVFNGASPRMERVLLLAQEEAVLWRLAAAKGISDLVTAQPGG

SEQ ID NO: 3462 - protein, 120 aa, Setaria italica
GLPHPEHCPLKDQEDETIQHLLCSCVFSRQFWFQLLRIFGLPDIAPQPSSTGFFDWWQQAGSTLDKRTKRGFNSLVILGAWLSWKERNDIVFNGASPTIERVLLLAQEEAALWRLASAKG

SEQ ID NO: 3463 - protein, 339 aa, Pennisetum glaucum
ARVGLEHPVRRFGHLQRFRWALRVRWLWLGKTEPNKPWAAFPVIVHGNAQALFAAAVTTAVGNGANTKFWTDRWLHGSSIQTLAPNLFATVPKRWVKRRTVQEALLDNKWVQDIQGHHTVAVLAEFLEVWDLVQEVILLPEVEDVHKWKFESSGQFSSKSAYEALFQGAVQLEPSALIWKNWGPRKCKFFLWLVAHNWCWAADRLAGRGLPHPEHCPFCDQEDETIQHILCSCVFSWQFWPQLLHRFGLPDIAPQPSAVGFFDWWQQAGSTLDKGAKKGFDSLVMLGAWILWKERNDIVFNGASPKLERALLLAQEEATLWMLAGAKGISGLVAARPAG

SEQ ID NO: 3464 - protein, 461 aa, Saccharum officinarum
MGHGVSCARTGDEHDYFRAAQVGDIDALDALLAADPSLAHRATLYDRLSALHIAAANGRLEVLSMILDHGVPPDAVNRHKQTPLMLAAMHGKIDCVLKLLQAGANILMFDSLHGRSCLHHASYFGHVDCLQAILTAARTTPVADSWGFARFVNVRDDHGATPLHLAARQGRPGCVQVLLENGAIVSALTGSYGFPGSTSLHLAARSGNLDCIRKLLAWGADRLQRDSAGRIPYAVALKRSHEACAALLNPSSAEPMVWPSPLKFISELDPEAKALLEAALMEANREREKKILKGTKYSPPSPSPCEHENDADAIDDASSEASDTELCCICFDQACTIEVQDCGHQMCAPCTLALCCHSKPNPTTLTLPSPACPFCRGSISRLLVARASTASSDDADKAASAAASSPQLVRRRSRRSHNLSDGGSSSFKGLSSAVAGSFSKIGRGSSRMADSDGMDKPEHDL

SEQ ID NO: 3465 - protein, 465 aa, Sorghum bicolor
MGHGVSCARTGDEHDYFRAAQVGDLDALGALLAADPSLARRATLYDRLSALHIAAANGRLEVLSMVLDHGVPPDAVNRHKQTPLMLAAMHGKIDCVLKLLQAGANILMFDSLHGRSCLHHASYFGNVDCLQAILTAARTTPVADSWGFARFVNVRDDHGATPLHLAARQGRPGCVQVLLENGAIVSALTGSYGFPGSTSLHLAARSGNLDCIRKLLAWGADRLQRDSAGRIPYAVALKRNHEACAALLNPSSAEPMVWPSPLKFISELDPEAKALLEAALMEANREREKKILKGTKYSPPSSPPSTCEHEIDADAIDDVSSETSDTELCCICFDQACTIEVQDCGHQMCAPCTLALCCHSKPNPTTLTLPSPACPFCRGNISRLLVARASTASLDADTDKAAAAAASSPQLVRRRSRRSHNLSDGGSSSFKGLSSAVAGSFSKIGRGSSRMADSDNGMDKPEHDL

SEQ ID NO: 3466 - protein, 191 aa, Sorghum bicolor
MSMPEAGQAAERDEQQQAQVIKALMQGICAVRYRKADNTPCPIAQGLYLGSVGAAFNKEALKSLNITHILIVARSLDPVFPAEFNYKKIEVLDSPDTDLLKHSDECFSFIDEAISSGGNCLVHCFAGRSRSVTIVVAYLMKKYQMSLESALSLVRSKRPQVAPNEGFISQLEKFQKSFQVEQERRMQSVQN

SEQ ID NO: 3467 - protein, 167 aa, Sorghum bicolor
MEAAGAASPPTEPPPTHPAVAPLAFLLGKWRGEGEGSFPTISSFRYGEELLFSHHPSKPVISYTQKTWKAASGEPMHAESGYWRPRPDGSVDVVIAQSTGLAEVQKGSYDAEKKTVTLQSELVGNASKVKQITRTFQVADGELSYVVQMATITTSLQPHLRALLKRI

SEQ ID NO: 3468 - protein, 167 aa, Saccharum officinarum
MEAAGAASPPTEPPMTHPAVAPLAFLLGKWRGEGEGSFPTISSFRYGEELLFSHHPSKPVISYTQKTWKPASGEPMHAESGYWRPRPDGSVDVVIAQSTGLAEVQKGSYDAEKKTVTLQSELVGNASKVKQITRTFHVAEGELSYVVQMATITTSLQPHLKALLKRI

SEQ ID NO: 3469 - protein, 167 aa, Panicum virgatum
MEAAGAGSPPSQPPAPHPAVAPLAFLLGKWRGEGEGSFPTISSFRYGEELLFSHHPSKPVISYTQKTWKAASGEPMHAESGYWRLRPDGSVEVVIAQSTGLAEVQKGSYDAEKKTVTLQSELVGNASKVKQITRAFQVSDGELSYVVQMATITTSLQPHLKALLKKI

SEQ ID NO: 3470 - protein, 168 aa, Panicum virgatum
MESAGAGTPAPTQPPVPHPAVAPLAFLLGKWRGEGEGSFPTISSFRYGEELLFSHHPSKPVISYTQKTWKAASGEPMHAESGYWRPRPDGSIEVVIVQSTGLAEVQKGSYDAEKKTVTLQSELVGNASKVKQITRAFQVADGELSYVVQMATITTSLQPHLKALLKRI

SEQ ID NO: 3471 - protein, 167 aa, Setaria italica
METAGAATPPTQPPATHPAVAPLAFLLGKWRGEGEGSFPAISSFRYGEELLFSHHPSKPVISYTQKTWKAASGEPMHAESGYWRPRPDGSVEVVIAQSTGLAEVQKGSYDAETKTVTLQSELVGNASKVKQITRAFQVTDGELSYVVQMATITASLQPHLKALLKKI

SEQ ID NO: 3472 - protein, 168 aa, Panicum virgatum
  misc_feature (86)..(86): Xaa can be any naturally occurring amino acid
MESAGAGTPAPTQPPVPHPAVAPLAFFLGKWRGEGEGSFPTISSFRYGEELLFSHHPSKPVISYTQKTWKAASGEPMHAESGYWRXRPDGSVEVVIVQSTGLAEVQKGSYDAEKKTVTLQSELVGNASKVKQITRAFQVADGELSYVVQMATITTSLQPHLKALLKRI

SEQ ID NO: 3473 - protein, 163 aa, Oryza sativa
MEGGGATAPAAPHPAVAPLAFLLGKWRGEGEGSFPTISPFRYGEELLFSHHPSKPVISYTQRTWKAASGEPMHAESGYWRPRPDGSVEVVISQSTGLAEVQKGSFDAEKKTVTLQSELVGNASKVKQITRAFQLVDGELSYVVQMATITTSLQPHLKALLKKI

SEQ ID NO: 3474 - protein, 162 aa, Pennisetum glaucum
METAGAGTPATHPAVAPLAFLLGKWRGEGEGSFPTISSFRYGEELLFSHHPSKPVISYTQKTWKAASGDPMHAESGYWRPRPDGSVEVVIAQSTGLAEVQKGSYDAENNTVTLQSEHVGNASKVKQITRAFQVVDGELSYVVQMATITTSLQPHLKGHPKKI

SEQ ID NO: 3475 - protein, 164 aa, Secale cereale
MEATGAPTQPPAPHPLVAPLSFLLGKWRGEGEGTFPTIAPFRYGEEILFSHHPSKPVISYTQRTWKAASGDPMHAESGYWRPRPDGSVEVVIAQSTGLTEVQTGSYDSEKKTVTLQSELIGNASKVKQITRAFQVVDGELSYVVQMATITNSLQPHLKALLKRI

SEQ ID NO: 3476 - protein, 479 aa, Brachypodium distachyon
MAGRRLTLLLLMAVAALSAGASGKSARFELIRSGPASFQEMALHDRDRVASFAAARGRRHGRRGARETAAGSASSSESAFAMPLTSAAYTGIGQYFVRFRVGTPAQPFLLVADTGSDLTWVKCRPAKAAAASTNSSSSASASSPRRAFRPEKSKTWAPIPCASDTCSKSLPFSLSTCPTPGSPCAYDYRYKDGSAARGTVGTESATIALSSSSSSSKNKVKKAKLQGLVLGCTGSYTGPSFEASDGVLSLGYSNVSFASHAASRFGGRFSYCLVDHLSPRNATSYLTFGPNSALSGPCPAAAGPGARQTPLVLDSRMRPFYDVSIKAISVDGELLKIPRDVWEVDGGGGVIVDSGTSLTVLAKPAYRAVVAALGKKLARFPRVAMDPFEYCYNWTSPSRKDEGDDLPKLAVHFAGSARLEPPSKSYVIDAAPGVKCIGVQEGPWPGISVIGNILQQEHLWEFDLKNRRLRFKRSRCTHS

SEQ ID NO: 3477 - protein, 164 aa, Triticum aestivum
MEAAGPPTQPPAPHPLVAPLSFLLGKWRGEGEGTFPSIAPFRYGEEILFSHHPSKPVISYTQRTWKAASGDPMHAESGYWRPRPDGSVEVVIAQSTGLTEVQTGSYDSEKKTVTLQSELIGNAAKVKQITRAFQVVDGELSYVVQMATITNSLQPHLKALLKRI

SEQ ID NO: 3478 - protein, 707 aa, Brachypodium distachyon
MSGFVGVVVSDPSLQGQFTQVELRSLKAKFVSLKRESGHVTTKNLPGLMKKLRGLNEVVSEEEIAAFLSESYPDSDQEIEFESFLRTYLNLQAKVTTKEENGGSGTGARKNSSSFLKSTITTLLHNLNQAEKSSYVAHINTYLGEDQFLKKYLPVDPSGNQLFDLIRDGVLLCKLINVAVPGTIDERAINKKRVLNPWERNENHTLCLNSAKAIGCTVVNIGTQDLVEGRPHLVLGLISQIIKIQLLADLNLKKTPQLVELFDDSKDIDEVLSLSPEKMLLRWMNHHLKKAGYKKTVNNFSSDVKDGEAYAYLLKALAPETSPETTLETKDPDQRAKLVLEQAEKLDCKRYLTPKDITEGSANLNLAFVAQIFQHRNGFTSDAKQVTLTQTASRDDVLVSREERAFRMWINSLGVETYVNNVFEDVRNGWVLLEVLDKVSPGSVSWKLASKPPIKMPFRKLENCNQVVKIGKELKFSLVNLAGNDIVQGNKKLIVALLWQLMRFNILQLLNKLRFHSQGSQGKEITDADILNWANSKVKASGRTSRIESFKDKSLSNGVFFLELLGAVQPRVVNWKVVTKGENDDEKKLNATYIISVARKLGCSVFLLPEDIIEVNQKMILTLTASIMYWSLQRQPQPQSETPEPSEPSSMASDATSDVGSEDGASTVAPSEGEEVNSLSESISNLTTDDATSNAPPAENGNDAAGS

SEQ ID NO: 3479 - protein, 706 aa, Oryza sativa
MSGFVGVVVSDPSLQGQFTQVELRSLKAKFLSLKRDSGGHATTKNLPGLMKKLRGLNEVISEEEIAAHLSQSYPDADQEIEFESFLREYLNLQSRVSAKEGGGGGGGGGKTASSFLKSSTTTLLHNLNQAEKSSYVAHINTYLREDPFLKKYLPIEPTDNQLFDLVRDGVLLCKLINLAVPGTIDERAINKKRVLNPWERNENHTLCLNSAKAIGCTVVNIGTQDLVEGRPHLILGLISQIIKIQLLADLNLKKTPQLVELFDDSKDIDEVLSLSPEKMLLRWMNHHLKKAGYKKTVSNFSTDVKDGEAYAYLLKALAPEHSPETTLETKDPSERAKLVLEQAEKLDCKRYLTPKDITEGSANLNLAFVAQIFQHRNGLTSDTRQVTLNQTASRDDVLLSREERSFRMWINSLGVDSYVNNVFEDVRHGWVLLEVLDKVSPGSVNWKLASKPPIKLPFRKLENCNQVVKIGKELKFSLVNLAGNDIVQGNKKLIVALLWQLMRFNMLQLLNRLRSHSQGSQGKEITDADILKWANSKVKASGRTSQMESFKDKSLSNGRFFLELLSAVQPRVVNWKVVTKGEDDEEKKLNATYTISVARKIGCSVFLLPEDIIEVNQKMILTLTASIMYWSLQKQPQSQSETSEQSEPSSMASDAASDIASEDAASITAASEGEEVNSLSDSMSNLTTYDAISNAPPAENGNGVAG

SEQ ID NO: 3480 - protein, 690 aa, Secale cereale
MSGFVGVVVSDPSLQGHFTQVELRSLKAKFVSLKRDSGHVTAKNLPGLMKKLRGLNEVVSEEEIAALLSEVYPDSDQEIEFEQFLQEYLNLQEKVSSKAGASGSKNSSSFLKSSTTTLIHNPNQAEKSSYVAHINAYLGNDPFLKKYLPIDPMGNDLFDLVRDGVVLCKLINVAVPGTIDERAINKKRILNPWERNENHTLCLNSAKAIGCTVVNLGAQDLVEGRTHLVLGLISQIIKIQLLADLNLKRTPQLVEIFDDSKDIDEVLSLSPEKLLLQWMNYHLKKAGYKKTVNNFSSDIKDAEAYAYLIKSLAPEHSSILAFDTKDPAVRAKVVLDQAEKLGCKRYLSPKDITEGSPNLNLAFVAQIFQHRNGLSDTRQVTLTQTSSRDEVVLSREERAFRMWINSLGIATYVNNVFEDVRTGWVILEVLDKVSPGSVNWKLATKPPIKMPFRKLENCNQVIKIGKELKFSLVNLAGNDIVQGNKKLIVALLWQLMRFNILQLLNKLRFHSQGSQGKEITDADILSWANNKVKVSGRNSRIESFKDKNLSSGIFFLELLSAVEPRVVNWKVVSKGVDDDEKKLNATYIISVARKLGCSVFLLPEDIIEVNQKMILTLTASIMYWSLQKPQQPETSEQSESSCTASDAASDIASEDAASIMAPSEGEEVNWLPDRASSMPTDDTSTSQAPA

SEQ ID NO: 3481 - protein, 143 aa, Sorghum bicolor
MAQRAMCLLRRSMGFMAPPAQRALSTTATPAAEGAAVAEATAKEVKRRKKKNLFDVVQFLPEWGIGYKVAKTTWRDVSYQITKINLYKDGRHGKAWGVRYKAGVQAADAPTRISGVNKRGWKYIKESQKKLQDAPKVDVAVAA

SEQ ID NO: 3482 - protein, 143 aa, Zea mays
MAQRTMCLLRRSIGFTAPQAQRALSTTAAPAAEGAAVAEATAKEAKRRRKNLFDVVQFLPEWGIGYKVAKTTWRDVSYQITKINLYKDGRHGKAWGLRYKAGVQAADTPTRISGVNKRGWKYIKESQKKLQEAPKVDVAVAAA

SEQ ID NO: 3483 - protein, 145 aa, Setaria italica
MAQRAMGLLRRSLGFAPPTAQRALSTSAAPAAEGAAAAAAEAVAKEAKKRKKKNLFDVVQFLPGWGVGYKVAKTTWRDVSYQITKINLYKDGRHGKAWGIRYKAGVQAADAPIRISGVNKRGWKYIKESQKKLQDAPKVEAPVSA

SEQ ID NO: 3484 - protein, 143 aa, Panicum virgatum
MAQRAMGLLRRSLGVAPPTAQRALSTSTAPPAEGAAAAAEATAKEAKKRKKNLFDVVQFLPGWGVGYKVAKTTWRDVSYQITKINLYKDGRHGKAWGIRYKAGVQAADAPTRISGVNKRGWKYIKESQKKLQDAPKVEAPVTA

SEQ ID NO: 3485 - protein, 145 aa, Cenchrus ciliaris
MAMAQRAMGLLRRSLGFTPPTAQRALSTSAAPAANGAAAAEEVAKEAKKRKKKNLFDVVQFLPGWGVGYKVAKTTWRDVSYQITKINLYKDGRHGKAWGIRYKAGVQAADTPIRISGVNKRGWKYIKESQKKLQDAPKVEAPVSA

SEQ ID NO: 3486 - protein, 146 aa, Panicum virgatum
MAMAQRAMGLLRRSLGLASPTSQRALSTSTAPPAEGAAAAAEATAKEAKKRKKKNLLDVVQFLPGWGVGYKVAKTTWRDVSYQITKINLYKDGRHGKAWGIRYKAGVQAADAPTRISGVNKRGWKYIKESQKKLQDAPKVEAPVTA

SEQ ID NO: 3487 - protein, 136 aa, Pennisetum glaucum
MATVQRAMGLLRRSLGFTPPTAQRALSSSAAPAADGAAEAAAKEAKKRRKKKNLFDVVQFLPGWGVGYKVAKTTWRDVSYQITKINLYKDGRHGKAWGIRYKAGVQAADAPIKISGVNKRGWKYIKESQKKLQDAP

SEQ ID NO: 3488 - protein, 89 aa, Panicum virgatum
MDYRYYCMTLRMNIDCNGCYQRIRRALLQIRELESHLIDKKHGRVMVCGAFSPQDVAIKIRKRTNRRVEILDVSEAAPAAQDGGPGHMP

SEQ ID NO: 3489 - protein, 94 aa, Zea mays
MDYYRQPYCIMTLRMSIDCNGCYQRIRRALLQMEGLESHLIDKKHGRVVVCGAAFSPQDVAIKIRKRTNRRVEILDVSEASPAAPEGGPGHMPS

SEQ ID NO: 3490 - protein, 89 aa, Panicum virgatum
MDYRYYCMTLRMSIDCNGCYQRIRRALLQIRELESHLIDKKHGRVMVCGAFSPQDVAIKIRKRTNRRVEILDVSEAAPAAQDGGPGHMP

SEQ ID NO: 3491 - protein, 89 aa, Panicum virgatum
MDYRYYCMTLRMSIDCNGCYQRIRRALLQIRELESHLIDKKHGLVMVCGAFSPQDVAIKIRKRTNRRVEILDVSEAAPAAQDGGPGHML

SEQ ID NO: 3492 - protein, 82 aa, Sorghum bicolor
MTLRMNIDCNGCYQRIRRALLQMQELESHLIDKKHGRVIVCGVFSPQDVAIKIRKRTNRRVEILDVSEVSPPAPEGAPGHMP

SEQ ID NO: 3493 - protein, 88 aa, Setaria italica
MDYRYCMTLRMNIDCNGCYQRIRRALLQIRELDSHLIDKRLGRVMVCGAFSPQDVAIKIRKRTNRRVEILDVREAAPASQDGGPGPMP

SEQ ID NO: 3494 - protein, 330 aa, Sorghum bicolor
MTDGARVEAAPRLAQWRVEALPCYTYRKSLPFRIGLWNWYLSVERNNKQTCVKLFAENPNSPKNGPSAPIASFITKLLISLPPNQQTIVHPGIFDKQLKHDGFVWAIDSTVTGRFVIEIEFLDLKVADPSGGEPASIWASRQIKQCSDSTALSSLARMLHEDILTDITINAADGSVRAHRAILATRSPVFRSMFSHDLREKELSTVDISDMSLDACRAFLSYIYGDVSGEEFLANRLALLRAADKYDIDDLREACHESLLEDINMGNVLERLQTAHLYQLPRLKGGCLRFLVDFRKVYEMHDDLNAFLQTADRDLVAEVFHGVLAAWSGR

SEQ ID NO: 3495 - protein, 330 aa, Pennisetum glaucum
MTDGARVEAAPRLAQWRVDALPCYTYRKSLPFRIGLWNWYLSVERNNKQTCVKLFAENSNSAKNGPSAPIASFVTKLLISLPPNQQTIVHPGIFDKQLKHEGFVWAIDSSVTGRFVIEIEFLDLKIADPSGGEPASIWASQQIKQTSDNTSLSALARMLHEDILTDITINAADGSVRAHRAMLAARSPVFRSMFSHDLREKELSAVDIPDMSLDACHAFLNYIYGDLRGEEFLANRLALLRAADKYDMADLKEACHESLLEDIDTGNVLERLQTAHLYRLPRLKGGCLRFLVDFRKVYEMHDDLGAFLQTAERDLVAEVFHGVLAAWSGR

SEQ ID NO: 3496 - protein, 330 aa, Panicum virgatum
MTDGARVEAAPRLAQWRVDALPCYTYRKSLPFRIGLWNWYLSVERNNKQTCVKLFAENSNSTKNGPSAPIASFVTKLLISLPPNQQTIVHPGIFDKQLKHDGFVWAIDSSVTGRFVIEIEFLDLKVADPSGGEPASIWASHQIKQSSDNIALSALSRMLHEDILTDITINAAVGSVRAHRAILASRSPVFRSMFSHDLREKELSTVDISDMSLEACHAFLHYIYGDLRSEEFLANRLALLRAADKYDMADLKEACHESLLEDIDTGNVLERLQTAHLYRLPRLKGGCLRFLVDFRKVYEMHDDFNVFLQTAERDLVAEVFHGVLAAWSGR

SEQ ID NO: 3497 - protein, 330 aa, Panicum virgatum
MTDGARVEAAPRLAQWRVDALPCYTYRKSLPFRIGLWNWYLSVERNNKQTCVKLFAENSNSTKNGPSAPIASFVTKLLISLPPNQQTIVHPGIFDKQLKHDGFVWAIDSTVTGRFVIEIEFLDLKVTDPSGGEPASIWASHQIKHSSDNIALSALSRMLHEDILTDITINAADGSVRAHRAILASRSPVFRSMFSHDLREKELSTVDISDMSLEACHAFLHYIYGDLRSEEFLANRLALLRAADKYDMADLKEACHESLLEDIDTGNVLERLQTAHLYRLPRLKGGCLRFLVDFRKVYEMHDDINVFLQTAERDLVAEVFHGVLAAWNGR

SEQ ID NO: 3498 - protein, 330 aa, Setaria italica
MTDGARVEAAPRLAQWRVDALPCYTYRKSLPFRIGLWNWYLSVERNNKQTCVKLFAENSNSAKNGHSAPIASFVTKLLISLPPNQQTIIHPGIFDKQLKHEGFVWAIDSSVTGRFVIEIEFLDLKIADPSGGEPASIWASQQIKQSSDNTALSALARMLHDDILTDITINAADGSVRAHRAILAARSPVFRSMFSHDLREKELSAVDIPDMSLDACHAFLNYIYGDLRSEEFLANRLALLRAADKYDMADLKETCHESLLEDIDTGNVLERLQTAHLYRLPRLKGGCLRFLVDFRKVYEMHDDLSAFLQTAERDLVAEVFHGVLAAWSGR

SEQ ID NO: 3499 - protein, 330 aa, Panicum virgatum
MTDGARVEAAPRLAQWRVDALPCYTYRKSLPFRIGLWNWYLSVERNNKQTCVKLFAENSNSTKNGPSAPIASFVTKLLISLPPNQQTIVHPGIFDKQLKHDGFVWAIDSTVTGRFVIEIEFLDLKVTDPSGGEPASIWASHQIKHSSDNIALSALSRMLHEDILTDITINAADGSVRAHRAILAWRSPVFRSMFSHDLREKELSTVDISDMSLEACHAFLHYIYGDLRSEEFLANRLALLRAADKYDMADLKEACHESLLEDIDTGNVLERLQTAHLYRLPRLKGGCLRFLVDFRKVYEMHDDINVFLQTAERDLVAEVFHGVLAAWNGR

SEQ ID NO: 3500 - protein, 314 aa, Panicum virgatum
RVDALPCYTYRKSLPFRIGLWNWYLSVERNNKQTCVKLFAENSNSTKNGPSAPIASFVTKLLISLPPNQQTIVHPGIFDKQLKHDGFVWAIDSSVAGRFVIEIEFLDLKVADPSGGEPASIWASHQIKQSSDNIALSALSRMLHEDILTDITINAAVGSVRAHRAILASRSPVFRSMFSHDLREKELSTVDISDMSLEACHAFLHYIYGDLRSEEFLANRLALLRAADKYDMADLKEACHESLLEDIDTGNVLERLQTAHLYRLPRLKGGCLRFLVDFRKVYEMHDDFNVFLQTAERDLVAEVFHGVLAAWSGR

SEQ ID NO: 3501 - protein, 329 aa, Brachypodium distachyon
MTGGRVEAAPRLAQWRVDALPCYTYRKSDPFRVGLWNWYLSVERNNKQTCVKLFAELSNSAKNTVPAPIASFVTKLLISFPPNEKIIVHPGIFDKHLKHDGFVWAIDSTVTGRFVIEIEFLDLKVPDPSGGEPASVWASHQIKQSSDNTALSSLTRMLQECILTDITINATDGSIRAHRAILAARSPVFRSMFSHDLKEKGLSTVDISDMSLDACRGFLNYVYGDLRNEEFLTHRLALLGAADKYDIADLREACHESLLEDIDTGNVIERLQVAHLYRLPRLKEGCLRFLVDFRKVYEMHDDFNAFLQTADRDLVAEVFQGVLAAWSGR

SEQ ID NO: 3502 - protein, 70 aa, Setaria italica
MSRARNALVATGLLIFAGAGLSFPFLFVKSKNRPIIDSTKPLPPQATFRGPYVNTGSRDIGPDPTNYPKK

SEQ ID NO: 3503 - protein, 70 aa, Unknown
  Sequence found in Organisms: Sorghum bicolor, Saccharum officinarum, Triticum aestivum
MSKARNALVATGLLVFAGAGLSFPFLFVKSKNRPIIDSSKPLPPQATFRGPYVNTGSRDIGPDPTNYPKK

SEQ ID NO: 3504 - protein, 70 aa, Panicum virgatum
MSRARNALVATGLLIFAGAGLSFPFLFVKSKNRPIIDSSKPLPPQATFRGPYVNTGSRDIGPDPTNYPKK

SEQ ID NO: 3505 - protein, 70 aa, Cynodon dactylon
MSKARNALVATGLLAFAGAGLTFPFFFVKSKNKPIIDSSKPLPPQATFRGPYVNTGSRDIGPDPTDYPKK

SEQ ID NO: 3506 - protein, 70 aa, Pennisetum glaucum
MSKVRNALVATGLLIFAGAGLSFPFLFVKSKNRPIIDSSKPLPPQATFRGPYVNTGSRDIGPDPTDYPKK

SEQ ID NO: 3507 - protein, 70 aa, Panicum virgatum
MSRAHNALVATGLLIFAGAGLSFPFLFVKSKNRAIIDSSKPLPPQATFRGPYVNTGSRDIGPDPTNYPKK

SEQ ID NO: 3508 - protein, 70 aa, Brachypodium distachyon
MSKARNALVATGLLIFAGSGLAFPFFFVKSKNKPIIDSSKPLPPQATFRGPYVNTGSRDIGPDPTEYPKK

SEQ ID NO: 3509 - protein, 70 aa, Hordeum vulgare
MSKARNAVVVTGLVIFAGSGLAFPFYFVKSKNRPIIDSTKPLPPQATFRGPYVNTGSRDIGPDPTEYPKK

SEQ ID NO: 3510 - protein, 70 aa, Oryza sativa
MSKARNVLVATGLLAFAGAGLAFPFYFVKSKNKPIIDSSKPLPPQATFRGPYVNTGSRDIGPDYTDYPKK

SEQ ID NO: 3511 - protein, 61 aa, Cynodon dactylon
MSKARNALVATGLLAFAGSGLAFPFFFVKSKKKPIIDSSKPLPPQATFRGPYVNTGSRYWT

SEQ ID NO: 3512 - protein, 70 aa, Avena sativa
MSRARNAVVVTGLVIFAGSGLAFPFYFVKSKNKPIIDSSKPLPPQATFRGPYVNTGSRDIGPDHTEYPKK

SEQ ID NO: 3513 - protein, 70 aa, Triticum aestivum
MSKARNALVVTGLVIFAGTGLAFPFYFVKSKNRPIIDSTKPLPPQATFRGPYVNTGSRDIGPDHTEYPKK

SEQ ID NO: 3514 - protein, 70 aa, Elaeis guineensis
MSRLRNVVMATGLLAFAGAGLSFPFFFVKSKNKPVTDSSKPLPPQATFRGPYVNTGSRDIGPDSSTYPKT

SEQ ID NO: 3515 - protein, 70 aa, Zostera marina
MSRLRNVLVATGLLVFAGGGLAFPFFFVKSKNKPIIDNTKPLPPQATFRGPYVNTGSRDVGPDSSTYSKK

SEQ ID NO: 3516 - protein, 192 aa, Sorghum bicolor
MGSGSFLKVLANNFDVLAGPLISLAYPLYASVRAIETKNPVDDQQWLTYWVLYSFITLFELTFAPIIEWLPFWSYAKLFFNCWLVLPWFNGAAYVYDHFVRPTFVNRQIVNIWYVPRNEKLGKSDDVLSAAERYIEQNGPEAFEKLISKSTKSSKSRNTKRSILEEAEAENRAKAERESWDENPFYDKNYRY

SEQ ID NO: 3517 - protein, 186 aa, Zea mays
MGSGSFLKVLAKNFDVLAGPLISLAYPLYASVRAIETKNPVDDQQWLTYWVLYSFVTLFELTFAPIIEWLPFWSYAKLFFNCWLVLPWFNGAAYVYDHFVRPMFVNRRIVNIWYVPRNEKLGKSDDVLSAAERYIEQNGPEAFEKLISKSTKSSKSRSTKRSILEEAEAERESWGENPFYDKNYRH

SEQ ID NO: 3518 - protein, 186 aa, Panicum virgatum
MGSGSFLKVLAKNFDVLAGPIISLAYPLYASVRAIETKNPVDDQQWLTYWVLYSFITLFELTFAPIIEWLPFWSYAKLFFNCWLVLPWFNGAAYVYDHFVRPMFVNRQIVNIWYVPRNEKSSKPDDVLSAAERYIEQNGPEAFEKLISKSTKSSKSRTTRRSILEEAEAERESWGENPFYDKNFRH

SEQ ID NO: 3519 - protein, 190 aa, Cynodon dactylon
MGSGSFLKVLVSNIDVLAGPLISLAYPLYASVRAIETKNPIDDQQWLTYWVLYSFITLFELTFAPIIEWLPFWSYAKLFFNCWLVLPWFNGAAYVYDHFVRPMFVNRQIVNIWYVPRKEKFSKPDDVLSAAERYIEQNGTEAFEKLISKSTKTSKSRGTRRSILEEAEAENIAKAERESWGENPFYDKNY

SEQ ID NO: 3520 - protein, 186 aa, Setaria italica
MGSGSFLKVLAKNFDVLAGPIISLAYPLYASVRAIETKNPIDDQQWLTYWVLYSFITLFELTFAPIIEWLPFWSYAKLFFNCWLVLPWFSGAAYVYDHFVRPMFVNRQIVNIWYVPRNDKPSKPDDVLSAAERYIEQNGPEAFEKLISKSTKSSKSRTTRRSILEDAEAERESWGENPFYDKNYRH

SEQ ID NO: 3521 - protein, 184 aa, Eragrostis curvula
MGSGSFLKVLVSNIDVLAGPLISLAYPLYASVRAIETKNPIDDQQWLTYWVLYSFITLFELTFAPIIEWLPFWSYAKLFFNCWLVLPWFNGAAYVYDHFVRPMFLNRQIVNIWYVPRTEKSSKPDDVLSAAERYIEQNGPEAFEKLISKSTKASKSRGTRRSILEEAERESWGENPFYDKNYRH

SEQ ID NO: 3522 - protein, 182 aa, Pennisetum glaucum
MGSGSFLKVLAKNFDVLAGPILSLAYPLYASVRAIETKNPIDDQQWLTYWVLYSFITLFELTFAPIIEWLPFWSYAKLFFNCWLVLPWFSGAAYVYDHFVRPMFVNRQIVNIWYVPRNDNPSKPDDVLSAAERYIEQNGPEAFEKLISKSTKSSKSRTTRRSILEEAEAEREAWGENPFYDK

SEQ ID NO: 3523 - protein, 193 aa, Oryza sativa
MGSGSFLKLLANNFDVLAGPLVSLAYPLYASVRAIETKSPVDDQQWLTYWVLYSFITLFELTFAPVIEWLPFWSYAKLFFNCWLVLPCFHGAAYVYDHFVRPMFVNRQIVNVWYVPRKENLSKPDDVLSAAERYIEQNGPEAFEKLISKSTRPSTSKRSTKQSILEEVESEHMARAERESWGENPFYDKNYRC

SEQ ID NO: 3524 - protein, 218 aa, Saccharum officinarum
MGSGSFLKVLANNFDVLAGPLISLAYPLYASVRAIETKNPVDDQQWLTYWVLYSFITLFELTFAPIIEWLPFWSYAKLFFNCWLVLPWFNGAAYVYDHFVRPMFVNRQIVNIWYVPRNEKLGKSDDVLSAAERYIEQNGPEAFEKLISKSTKSSKSRNTKRSILEEAEAENRAKAERESWGENPFYDKNYGSKPTSKFTKQLQTTFAHEPHAELLPTS

SEQ ID NO: 3525 - protein, 194 aa, Leymus cinereus x Leymus triticoides
MGSGSFLKVLAKNFDVLAGPLVSLAYPLYASVRAIETKSQVDDQQWLTYWVLYSFITLFELTFAPILEWLPFWPYGKLFFNCWLVLPCFNGAAYVYEHFVRPMFVNRQIVNIWYVPRKDKLSKPDDVLSAAEKYIELNGPEAFEKLISKSTSTKPSKFRSTRRSILQEVEAEKMGKAERDSWGENPFYDKNYRH

SEQ ID NO: 3526 - protein, 194 aa, Triticum aestivum
MGSGSFLKVLAKNFDVLAGPLVSLAYPLYASVRAIETKSQVDDQQWLTYWVLYSFITLFELTFAPILEWLPFWPYGKLFFNCWLVFPCFNGAAYVYEHFARPMFVNRQIVNIWYVPRKEKLSKSDDVLSAAEKYIELNGPEAFEKLISKSTSTKPSKFRSTRRSILQEAEAEKMGKAERDSWGENPFYDKNYRH

SEQ ID NO: 3527 - protein, 194 aa, Pseudoroegneria spicata
MGSGSFLKVLAKNFDVLAGPLVSLAYPLYASVRAIETKSQVDDQQWLTYWVLYSFITLFELTFAPILEWLPFWPYGKLFFNCWLVLPCFNGAAYVYEHFARPMFVNRQIVNIWYVPRKDKLSKPDDVLSAAEKYIELNGPEAFEKLISKSTSTKPSKFRSTRRSILQEAEAEKMGKAERDSWGENPFYDKNYRH

SEQ ID NO: 3528 - protein, 177 aa, Cenchrus ciliaris
  misc_feature (165)..(165): Xaa can be any naturally occurring amino acid
  misc_feature (173)..(173): Xaa can be any naturally occurring amino acid
MGSGSFLKVLAKNFDVLAGYASVRAIETKNPIDDQQWLTYWVLYSFITLFELTFAPIIEWLPFWSYAKLFFNCWLVLPWFSGAAYVYDHFVRPMFVNRQIVNIWYVPRNDKPSKPDDVLLAAERYIEQNGPEAFEKLISKSTKSSKSRTTRRSILEEAEAERDSXGENPFYDXSYRH

SEQ ID NO: 3529 - protein, 194 aa, Hordeum vulgare
MGSGSFLKVLAKNFDVLAGPLVSLAYPLYASVRAIETKSQVDDQQWLTYWVLYSFITLFELTFAPILEWLPFWPYGKLFFNCWLVFPCFNGAAYVYEHFARPMFVNRQIVNIWYVPRKDKLSKPDDVLSAAEKYIELNGPEAFEKLISKSTSTKPSKFRSTRRSILQGAEAEKMGKAERDSWGENPFYDKNYRH

SEQ ID NO: 3530 - protein, 192 aa, Avena sativa
MGSGSFLKVLAKNFDILAGPLVSLAYPLYASVRAIETKSQVDDQQWLTYWVLYSFITLFELTFAPILEWLPFWPYGKLFFNCWLVLPCFNGAAYVYEHFVRPMFLNRQIVNIWYVPRKDKSSKPDDVLSAAEKYIELNGPEAFEKLISKSTKPSNFRSKRLSVLQEAKADRAGKAERESWGENPFYDKNYRH

SEQ ID NO: 3531 - protein, 192 aa, Brachypodium distachyon
MGSGSFLKVVAKNFDILAGPVISLAYPLYASVRAIETKSQVDDQQWLTYWVLYSCITLVELTFAPVIEWLPFWPYAKLFFNCWLVLPCFNGAAYVYQYFVRPMFVNRQIVNIWYVPRKDKLSKPDDVLSAAERYIELNGPEAFEKLISKSTRASNSRSMRRSILQESEADKIGKAERESWGENPFYDKNYRH

SEQ ID NO: 3532 - protein, 196 aa, Secale cereale
MGSGSFLKVLAKNFDVLAGPLVSLAYPLYASVRAIETKSQVDDQQWLTYWVLYSFITLFELTFAPILEWLPFWPYGKLFFNCWLVFPCFNGAAYVYEHFARPMFVNRQIVNIWYVPRKDKLSKPDDVLSAAEKYIELNGPEAFEKLISKSTSTSTKPSKFRSTRRSILQEAEAEKMGKAERDSWGENPFYDKNYRH

SEQ ID NO: 3533 - protein, 192 aa, Lolium multiflorum
MGSGSFLKVLAKNFDILAGPLVSLAYPLYASVRAIETKSQVDDQQWLTYWVLYSFITLFELTFAPILEWLPFWPYGKLFFNCWLVLPCFNGAAYVYEHFVRPMFLNRQIVNIWYVPRKDKLSKPDDVLSAAEKYIELNGPEAFEKLISKSSKPSNFRSRRLSVLQEAKADRTGKAERESWGENPFYDNSYRH

SEQ ID NO: 3534 - protein, 356 aa, Zea mays
MGVAGEKFQLGTVGALSLSVVSSVSIVICNKALMSSLGFNFATTLTSWHLLVTFCSLHVALCMKLFEHKPFDARTVMGFGVLNGISIGLLNLSLGFNSVGFYQMTKLAIIPCTVILETLFFRKKFSRNIKLSLSVLLLGVGVATVTDLQLNVMGSVLSLLAIITTCIAQIMTNTIQKKFKVSSTQLLYQSCPYQALTLFLVGPFLDGFLTNQNVFAFDYTTQVLFFIVLSCLISVSVNFSTFLVIGKTSPVTYQVLGHLKTCLVLTFGYVLLHDPFSWRNILGILIAVIGMVLYSYFCTRETQQKPAEASPQAVQAKEGESNPLISDSLSAAENGGSATDDEPLKVPMWSSKYSKA

SEQ ID NO: 3535 - protein, 356 aa, Pennisetum glaucum
MGVAGEKFQLGTVGALSLSVVSSVSIVICNKALMSSLGFNFATTLTSWHLLVTFCSLHVALCMKLFEHKPFDARTVMGFGVLNGISIGLLNLSLGFNSVGFYQMTKLAIIPCTVILETLFFRKKFSRNIKLSLSVLLLGVGVATVTDLQLNAVGSVLSLLAIITTCIAQIMTNTIQKKFKVSSTQLLYQSCPYQALTLFVVGPFLDGFLTNQNVFAFDYTTQVLFFIVLSCLISVSVNFSTFLVIGKTSPVTYQVLGHLKTCLVLTFGYVLLHDPFSWRNILGILIAVIGMVLYSYFCTRETQQKPAEVSPQVSQGKESESNPLISDSLNAAENGGSTPDDEPLKVPMWSSKYSRS

SEQ ID NO: 3536 - protein, 354 aa, Zea mays
MGVGGEKFQLGTVGALSLSVVSSVSIVICNKALMSSLGFNFATTLTSWHLLVTFCSLHVALWMKFFEHKPFDSRTVMGFGVLNGISIGLLNLSLGFNSVGFYQMTKLAIIPCTVILETLFFRKKFSRSIQMSLSVLLLGVGVATVTDLQLNAVGSILSLLAIITTCIAQIMTNTIQKKFKVSSTQLLYQSCPYQSLTLFLIGPFLDGFLTNQNVFAFNYTSQVVFFIVLSCLISVSVNFSTFLVIGKTSPVTYQVLGHLKTCLVLTFGYVLLHDPFSWRNILGILIAVVGMVLYSYFCTVETQHKNTEVSPQQVKESEAAPLISDSLSKVENGGGVVDDEPLKVPMWSSKYSRE

SEQ ID NO: 3537 - protein, 352 aa, Triticum aestivum
MGVGGEKFQLGTVGALGLSVVSSVSIVICNKALMSSLGFTFATTLTSWHLLVTFCSLHVALWMKFFEHKAFDSRTVMGFGVLNGISIGLLNLSLGFNSVGFYQMTKLAIIPCTVILETLFFRKKFSRTIQISLSVLLLGVGVATMTDLQLNAVGSILSLLAIITTCIAQIMTNTIQKKFKVSSTQLLYQSCPYQSLTLFLIGPFLDGFLTNQNVFAFNYTSNVVFFIVLSCLISVSVNFSTFLVIGKTSPVTYQVLGHLKTCLVLTFGYVLLHDPFSWRNILGILIAVVGMVLYSYFCSTETQPKNTDVSAQQSKEGDSAPLISDSLSKVENGGDDDEPLKVPMWSSKYSRA

SEQ ID NO: 3538 - protein, 352 aa, Triticum aestivum
MGVGGEKFQLGTVGALGLSVVSSVSIVICNKALMSSLGFTFATTLTSWHLLVTFCSLHVALWMKFFEHKAFDSRTVMGFGVLNGISIGLLNLSLGFNSVGFYQMTKLAIIPCTVILETLFFRKKFSRTIQISLSVLLLGVGVATVTDLQLNAVGSILSLLAIITTCIAQIMTNTIQKKFKVSSTQLLYQSCPYQSLTLFLIGPFLDGFLTNQNVFAFNYTSNVVFFIVLSCLISVSVNFSTFLVIGKTSPVTYQVLGHLKTCLVLTFGYVLLHDPFSWRNILGILIAVVGMVLYSYFCSIETQPKNTDVSAQQSKEGDSAPLISDSLSKVENGGDDDEPLKVPMWSSKYSRA

SEQ ID NO: 3539 - protein, 231 aa, Secale cereale
MGVGGEKFQLGTVGALGLSVVSSVSIVICNKALMSSLGFTFATTLTSWHLLVTFCSLHVALWMKFFEHKAFDSRTVMGFGVLNGISIGLLNLSLGFNSVGFYQMTKLAIIPCTVILETLFFRKKFSRTIQISLSVLLLGVGVATVTDLQLNAVGSILSLLAIITTCIAQIMTNTIQKKFKVSSTQLLYQSCPYQSLTLFLIGPFLDGFLTNQNVFAFNYTSNVFFSSSCRV

SEQ ID NO: 3540 - protein, 352 aa, Triticum aestivum
MGVGGEKFQLGTVGALGLSVVSSVSIVICNKALMSSLGFTFATTLTSWHLLVTFCSLHVALWMKFFEHKAFDSRTVMGFGVLNGISIGLLNLSLGFNSVGFYQMTKLAIIPCTVILETLFFRKKFSRTIQISLSVLLLGVGVATVTDLQLNAVGSILSLLAIITTCIAQIMTNTIQKKFKVSSTQLLYQSCPYQSLTLFLIGPFLDGFLTNQNVFAFNYTSNVVFFIVLSCLISVSVNFSTFLVIGKTSPVTYQVLGHLKTCLVLTFGYVLLHDPFSWRNILGILIAVVGMVLYSYFCSIETQPKNTDVSAQQSKEGDSAPLISDSLGKVENGGDDDEPLKVPMWSSKYSRA

SEQ ID NO: 3541 - protein, 352 aa, Populus trichocarpa
MSEGQKFQLGTVGALSLSVVSSVSIVICNKALISTLGFTFATTLTSWHLLVTFCSLHVALCMKLFEHKPFDARAVMGFGILNGISIGLLNLSLGFNSVGFYQMTKLAIIPCTVLLETLFFRKQFSRNIQLSLSILLMGVGIATVTDLQLNVLGSVLSLLAVLTTCVAQIMTNTIQKKFKVSSTQLLYQSCPYQALTLFIVGPFLDGLLTNKNVFAFKYTPQVLFFIVLSCLISVSVNFSTFLVIGKTSPVTYQVLGHLKTCLVLAFGYVLLRDPFSWRNILGILIAVVGMVLYSYCCTIESQQKQNEVPVKLPEVKESETDPLISVENGTGILADVAVPNVPVWTSNKDLDA

SEQ ID NO: 3542 - protein, 291 aa, Tripterygium wilfordii
MKFFEHKPFDARAVMVFGILNGISIGLLNLSLGFNSVGFYQMTKLAIIPCTVLLETLFFMKKFSRSIQLSLAILLLGVGIATVTDLQLNLLGSILSLLAVITTCVAQIMTNTIQKKFKVSSTQLLYQSSPYQAITLFIVGPFLDGLLTNKNVFAFNYTLQVVFFIVLSCLISVSVNFSTFLVIGKTSPVTYQVLGHLKTCLVLAFGYVLLRDPFSWRNILGILVAIVGMVLYSYYCTLETQQKASEASAQAQLVKEGESDPLISVENGSGISADGVVATGPVWKSNKDLQA

SEQ ID NO: 3543 - protein, 352 aa, Musa acuminata
MGEGGGFQLGTVGALSLSVVSSVSIVICNKALMSSLGFIFATTLTSWHLLVTFCSLHVALLMKLFEHKPFDRKAVMGFGVLNGISIGLLNLSLGFNSVGFYQMTKLAIIPCTVFLETVFLAKKFSRSIQLSLTILLLGVGIATVTDLQLNLLGSVLSLLAVVTTCIAQIMTNTIQKKFKVSSTQLLYQSAPYQALTLFISGPFLDGLLTNQNVFAFNYTPQVLIFIVLSCLISVSVNFSTFLVIGKTSPVTYQVLGHLKTCLVLAFGYVLLHDPFSWRNIFGILVAIVGMVFYSYFCTIEGQQKAREASSQVLQVKDDESDPLIGTETGAGINDDGAAQTAQAWSSNKDLHA

SEQ ID NO: 3544 - protein, 120 aa, Platanus occidentalis
MSESERFQLGTIGALSLSVVSSVSIVICNKALISTLGFTFATTLTSWHLLVTFCSLHVALWMKLFEHKPFDARAVMGFGVLNGISIGLLNLSLGFNSVGFYQMTKLRNYSLYCSFGDSFL

SEQ ID NO: 3545 - protein, 313 aa, Sorghum bicolor
MAATAKYNRSNPAVKRILQEVKEMQSNPSPDFMALPLEEDIFEWQFAILGPRDSEFEGGIYHGRIQLPSDYPFKPPSFMLLTPSGRFEIQKKICLSISNYHPEHWQPSWSVRTALVALIAFMPTNPGGALGSLDYKKEDRRALAIKSREAPPKFGSSERQKLIDEIHEQMLSKAPPVPQALPNVPNEESNQLPTPNASGEHADKVDEGDNTSGSMSGSLSGLPVPESESGVAENTGEASAVEVANHHVPEASHRENIPTVPSSLQNPAVAIQKPKHDRLLTLAAFGLTLAIMALVIKKFLKINGLGGFIEGKF

SEQ ID NO: 3546 - protein, 312 aa, Saccharum officinarum
MAASAKYNRSNPAVKRILQEVKEMQSNPSPDFMALPLEEDIFEWQFAILGPRDSEFEGGIYHGRIQLPSDYPFKPPSFMLLTPSGRFEIQKKICLSISNYHPEHWQPSWSVRTALVALIAFMPTNPGGALGSLDYKKEDRRALAIKSREAPPKFGSPERQKLIDEIHEQMLSKAPPVPQAIPNVPNEESNQLPAPDSSEHADKVDEGDNTSGSMSGSLSGHPVPESESPVAENTGETSAVEVANHHVPEASRRENIPRVPSSLQNPAVAIQKPKHDRLLTLAAFGLTLAIMALVIKKFLKINGMGGFIDGKF

SEQ ID NO: 3547 - protein, 309 aa, Zea mays
MAATIQYNRSNPAVKRILQEVKEMQSNPSPDFMSLPLEEDIFEWQFAILGPRDSEFEGGIYHGRIQLPSDYPFKPPSFMLLTPSGRFEIQKKICLSISNYHPEHWQPSWSVRTALVALIAFMPTNPGGALGSLDYKPEDRRALAIKSREVPPKFGSPQRQKLIDEIHEQMLSKAPPIPQTLPNVPNEELAPDSCDEHADKVDEGGNTSKSMSGSSSGHPVPEAESLAAENTGEASAVEVANHQVPEASRRESIPRVPSSLQNAAIATQKPKHDRLLTLAAFGLTLAIMALVIKKFLKINGLGGFIEGKF

SEQ ID NO: 3548 - protein, 308 aa, Setaria italica
MAATAKYNRSNPAVKRILQEVKEMQSNPSPDFMALPLEEDIFEWQFAILGPRDSEFEGGIYHGRIQLPSDYPFKPPSFMLLTPSGRFEIQKKICLSISNYHPEHWQPSWSVRTALVALIAFMPTNPGGALGSLDYKKEDRRALAIKSREAPPKFGSPERQKLIEEIHEQMLTKAPPVPQALPNGPNDESNQLPAADSFGEHADKADEGGSVSVSSDLTEPQSESGVAENTAEPPVAEVTNPHLPEASHRENIPRVPLAPQNPVVAIQKPKHDRLLTLAAFGLTLAIMALVIKKFLKINGLAGFIEGKF

SEQ ID NO: 3549 - protein, 313 aa, Panicum virgatum
MAATAKYNRSNPAVKRILQEVKEMQSNPSPDFMALPLEEDIFEWQFAILGPRDSEFEGGIYHGRIQLPSDYPFKPPSFMLLTPSGRFEIQKKICLSISNYHPEHWQPSWSVRTALVALIAFMPTNPGGALGSLDYKKEDRRALAIKSREATPKFGSPERQKLIDEIHEQMLSKAPPVPQALPNGPNEESNQLPAPDSFVENADRADEGGNTVGSVSDSLNDLTGPESETGVAENTVEPPVAEVTHRHLPEASHRENSPRVPLAPQNPVVAIQKPKHDRLLTLAAFGLTLAIMALVVKKFLKINGLAGFIEGKF

SEQ ID NO: 3550 - protein, 313 aa, Panicum virgatum
MAATAKYNRSNPAVKRILQEVKEMQSNPSPDFMALPLEEDIFEWQFAILGPRDSEFEGGIYHGRIQLPSDYPFKPPSFMLLTPSGRFEIKKKICLSISNYHPEHWQPSWSVRTALVALIAFMPTNPGGALGSLDYKKEDRQALAIKSREAPPKFGSPERQKLIDEIHEQMLSKAPPVPQVLPNGTNEESNHLPAPDSFVENADRADEGGNTVGSVSGSLNDLTGPESEMGVAENTVEPPVAEVTNPHLPEASHRENSPRVPLAPQNPVVAIQKPKHDRLLTLAAFGLTLAIMALVIKKFLKINGLAGFIEGKF

SEQ ID NO: 3551 - protein, 309 aa, Pennisetum glaucum
MAATAKYNRSNPAVKRILQEVKEMQSNPSPEFMALPLEEDIFEWQFAILGPRDSEFEGGIYHGRIQLPSDYPFKPPSFMLLTPSGRFEIQKKICLSISNYHPEHWQPSWSVRTALVALIAFMPTNPGGALGSLDYKKEDRQALAIKSREAPPKFGSPERQKLIDEIHEQMLSKAPPVPQALPNGPNEESNQLPAVDSFGEYGDKVDEGGSVSGSLSDLAEPQPAVGVAENAAEPPVAEVTNPYLPEASHRENIPRVPLAPQNPVGAVQKPKHDRLLTLAAFGLTLAIMALLIKKFLKINGLAGFIDGKF

SEQ ID NO: 3552 - protein, 313 aa, Oryza sativa
MEATAKYNRGNPAVKRILQEVKEMQSNPSPDFMAMPLEEDIFEWQFAILGPRDSEFEGGIYHGRIQLPSDYPFKPPSFMLLTPSGRFEIQKKICLSISNYHPEHWQPSWSVRTALVALIAFMPTPGGGALGSLDFKKEDRRALAIKSRETPPKFGSAERQKVIDEIHEQMLSRAPPVPQLLTNETNEETNQLPASDASDEHAHKAVGGVNTAGSNSDSVNNDLPRPDSESEIVQHIVEGRTEGVSNHSRANLSRENIPRVAPTPQNPVVAIQKPKHDRLLTLAAFGLTLAIMALVIKKFFKINGLAGYIEGKF

SEQ ID NO: 3553 - protein, 308 aa, Cenchrus ciliaris
  misc_feature (123)..(123): Xaa can be any naturally occurring amino acid
  misc_feature (127)..(127): Xaa can be any naturally occurring amino acid
  misc_feature (132)..(132): Xaa can be any naturally occurring amino acid
  misc_feature (134)..(134): Xaa can be any naturally occurring amino acid
  misc_feature (138)..(138): Xaa can be any naturally occurring amino acid
  misc_feature (182)..(182): Xaa can be any naturally occurring amino acid
  misc_feature (187)..(187): Xaa can be any naturally occurring amino acid
MAAAAKYNRSNPAVKRILQEVKEMQSNPSPDFMALPLEEDIFEWQFAILGPRDSEFEGGIYHGRIQLPSDYPFKPPSFMLLTPSGRFEIQKKICLSISNYHPEHWQPSWSVRTALVALMHYAXKPWXGIGLXGXKKEXRQALAIKSREAPPKFGSLERQKLIDEIHELMLSKAPPVPQALPXSPNEXSNQLPAADPFGEHGDKVDEGGSVSGSLSDLAEPQPASGVAENTAEPPVAEFTNPHQPEASHRENIPRVPLAPQNPVVAIQKPKHDRLLTLAAFGLTLAIMALVIKKFLKINGLAGFIEGKF

SEQ ID NO: 3554 - protein, 146 aa, Sorghum bicolor
MNIQRKPGDWNCKNCQHLNFSRRDYCQRCRDPRPDLQFSDSYSTGGVLTSLDIRPGDWYCSCGYHNFASRSSCFKCGTIVRDFPAGQGAAGAEVDFARGRDSAAVRAGWKAGDWICTRPGCNVHNFASRMECYRCNGPREAAGTGK

SEQ ID NO: 3555 - protein, 146 aa, Setaria italica
MNIQRKPGDWNCKNCQHLNFSRRDYCQRCRDPRPDLQFSDGYSTGGVLTSLDIRPGDWYCSCGYHNFASRSSCFKCGTIVRDFPGGQGAAGAEGDFARGRDSAAVRAGWKAGDWICTRPGCNVHNFASRTECYRCNAPRDAVGTGN

SEQ ID NO: 3556 - protein, 254 aa, Panicum virgatum
MVATDWSDKDAMGDLAIAGHARALLEWHNTAKFCGACGAKAVPTEAGRRKQCSNESCKKRIYPRVDPVVIMLVIDKENDRALLSRQSRFVPRMWSCLAGFIEPGESLEEAVRRETWEETGIEVGQVIYHSSQPWPVGPNTMPCQLMVGFFAYAKSLEIHVDKQELEDAQWHSREDIKKALTFAEYENAQRTNALKVNQMCKGAEKGQSIAEDFKVGGGEPVPMFVPGPFAIAHHLISAWAFEGAPKVPSSFSNL

SEQ ID NO: 3557 - protein, 890 aa, Sorghum bicolor
MRKLFFSESACKETKLHSAPHSWLPLERGKLSKFSGHAAASSSIDSLMKMPEPAVLPHFKPADYVDILAQIHEELESCSPDEKSCLYLLQFQVFRGLGEAKLSRRSLQSAWEKASTIHEKLIFGAWLKYEKKGEEAIADLLSSCGKCSQEFRLLDFVSQVSTGSHVMSYDDDDDESDEFQGSAVVHFRIRDDMIACDRRKLAALSTPLYAMLNGGFRESYLEVIDMSRNGISPIGMRAISKFSLSGRLPYLSADAILEMLDFANKFCCKGLKDACERKLASFVSSRQDAIDFMECALELGCSILAASCLQVLLNELPECLNDEQVVRIFSSANKAQRLTMVGNASFSLYCLLSEVSMSTNPTSDVTVSFLEKLVESASDSRQKQLALHQLACTRFLRKDYPESERLFNAAFSAGHLYSLVGLARLAALRGNKHFALKFLDSVMSSRWPLGWMYQERALYLEGDNKLENLNKATELDPTLTYPYMFRAASLMKRQSVEAALMEINRILGFKLVLECLELRFCCYLALEDYRAALCDVQAILTLAPDYRMIGGRVAAKQLRMLVLENVEQWTAADCWMQLYDRWSSVDDIGSLSVIYQMLESDNAKGVLYFRQSLLLLRLNCPEAAMRSLQLAREHASSDHERLVYEGWILYDTGHCEEGLQKAEASIAIQRSFEAFFLKAYALADSSLDPSTSATVVSLLEDALRCPSDRLRKGQALNNLGSVYVDCGKLDLAAECYINALKIGHTRAHQGLARVHFLRNNRAGAYDEMTKLIEKARNNASAYEKRSEYCDRELTKTDLQMVTKLDPLRVYPYRYRAAVLMDNHKEKEAIAELTKAIAFKADLNLLHLRAAFHEHIGDISSALRDCRAALSVDPNHQEMLELHHRVNSQEP

SEQ ID NO: 3558 - protein, 887 aa, Setaria italica
MRKLFFSESACKETKLHSAPHSWLPLERGKLSKFSGHAAGGSSIESLMKMPEPAVLPHFKPADYVDKLAQIHEELESCPPDEKSCLYLLQFQVFRGLGEAKLSRRSLQSAWEKASTIHEKLIFGAWLKYEKKGEEAISDLLSSCGKCSQEFRLLDFVSQVSTGSHDMSYDDESDEFRGSAVVHFRIRDDMIACDRRKLAALSTPLYAMLNGGFRESYLEVIDMSRNGISPIGMRAISKFSLSGRLPYLSADAILEMLDFANKFCCKGLKDACERKLASFVSSRQDAIDFMECALELGCSILAASCLQVLLNELPECLNDEQVVRIFSSANKQQRLTMAGNASFSLYCLLSEVSMSTNPTSDVTVSFLEKLVESALDSRQKQLALHQLACTKFLRKDYAEAERLFNAAFSAGHFYSVVGLARLASLRGNKHFALKLLDSVMSSRWPLGWMYQERALYLDGDSKLENLNKATELDPTLTYPYMFRAASLMKRQSVEAALMEINRILGFKLVLECLELRFCCYLALEDYRAALCDVQAILTLAPEYRMIGGRVAAKQLRMLVLENVEQWTTADCWMQLYDRWSSVDDIGSLSVIYQMLESDTAKGVLYFRQSLLLLRLNCPEAAMRSLQLAREHAASDHERLVYEGWILYDTGHCEEGLQKAEASIAIQRSFEAFFLKAYALADSSLDPSTSATVVSLLEDALRCPSDRLRKGQALNNLGSVYVDCGKLDLAAECYINALKIGHTRAHQGLARVHFLRNNRTGAYDEMTKLIEKARNNASAYEKRSEYCDRELTKADLQMVTKLDPLRVYPYRYRAAVLMDNHKEKEAIAELTKAIAFKADLNLLHLRAAFHEHIGDISSALRDCRAALSVDPNHQEMLELHHRVNSQEP

SEQ ID NO: 3559 - protein, 887 aa, Zea mays
MRKLFFSESACKETKLHSAPHSWLPLERGKLSKFSGHAAAGSSIESLMKMPEPAVLPHFKPADYVDVLAQIHEELESCPPDDKSSLYLLQYQVFRGLGEAKLSRRSLQSAWEKGSTIHEKLIFGAWLKYEKKGEEAISDLLSSCSKCLQEFRLLDFVLQVSTGSHVINYDGDDDEFRGSAVVHFRIRDDMVACDRRKLAALSTPLYAMLNGGFRESYLEVIDMSRNGISPIGMRAISKFSLSGRLPYLSADAILEILDFANKFCCKGLKDACERKLASFVSSRQDAIDFMECALELGCSILAASCLQVLLNELPECLNDEQVVRIFSSANKAQRLTMVGNASFSLYCLLSEVSMSTNPTSDVTVSFLEKLVESASDSRQNQLALHQLACTKFLRKDYPESERLFNAAFSAGHLYSIVGLARLASLRGNKHFALKLLDSVMSSRWPLGWMYQERALYLDGDNKLENLNKATELDPTLTYPYMFRAASLMKRQSVEAALMEINRILGFKLVLECLELRFCCYLALEDYRAALCDVQAILTLAPDYRMIGGRVAAKQLRMLVLENVEQWTAADCWMQLYDRWSSVDDIGSLSVIYQMLESDTAKGVLYFRQSLLLLRLNCPEAAMRSLQLAREHAASDHERLVYEGWILYDTGHCEEGLQKAEASIAIQRSFEAFFLKAYALADSSLDPSTSATVVSLLEDALRCPSDRLRKGQALNNLGSVYVDCGKLDLAAECYINALKIGHTRAHQGLARVHFLRNNRAGAYDEMTKLIEKARNNASAYEKRSEYCDRELTKTDLQMVTKLDPLRVYPYRYRAAVLMDNHKEKEAIAELTKAIAFKADLNLLHLRAAFHEHVGDVSSALQDCRAALSVDPNHQEMLELHHRVNSQEP

SEQ ID NO: 3560 - protein, 286 aa, Panicum virgatum
MRKLFFSESACKETKLHSAPHSWLPLERGNLSKSSAHASGGTSIESLMKMPEPAVLPHFKPADYVDILAQIHEELESCPLDEKSCLYLLQFQVFRGLGEAKLSRRSLQSAWEKASTIHEKLIFGAWLKYEKKGEEAISDLLSSCGKCSQEFRLLDFVSQASTGSHDMSYDEESDEFRGSAVVHFRIRDDMIACDRRKLAALSTPLYAMLNGGFRESYLEVIDMSRNGISPIGMRAIVNSACQEDYRICQLMLFWKCLILPINFAARASRMLASESLLLLSLQGKML

SEQ ID NO: 3561 - protein, 887 aa, Panicum virgatum
MRKLFFSESACKETKLHSAPHSWLPLDRGGLSKSAAHASGGTSIESLMKMPEPAVLPHFKPADYVDILAQIHEELESCPPDERSCLFLLQFQVFRGLGEAKLSRRSLQSAWEKASTIHEKLIFGAWLKYEKKGEEAISDLLSSCGKCSQEFRLLDFVSQVSTGSHDMGYDEGSDEFRGSAVVHFRIRDDMIACDRRKLAALSTPLYAMLNGGFRESYLEVIDMSRNGISPIGMRAISKFSLSGRLPYLSADAILEMLDFANKFCCKGLKDACERKLASFVSSRQDAIDFMECALELGCSILAASCLQVLLNELPECLNDEQVVRILSSANKQQRLTMVGNASFSLYCLLSEVSMSTNPTSDVTLSFLEKLVESASDSRQKQLALHQLACTRFLRKDYAEAEPLFSAAFSAGHLYSVVGLARLTSLRGNKHFALKLLDSVMSSRWPLGWMYQERALYLDGDSKLENLNKATELDPTLTYPYMFRAASLMKRQSVEAALMEINRILGFKLVLECLELRFCCYLALEDYRAALCDVQAILTLAPDYRMIGGRVAAKQLRMLVLENVEQSTTADCWMQLYDRWSSVDDIGSLSVIYQMLESDTSKGVLYFRQSLLLLRLNCPEAAMRSLQLAREHAASDHERLVYEGWILYDTGHCEEGLQKAEASIAIQRSFEAFFLKAYALADSSLEPSTSATVVSLLEDALRCPSDRLRKGQALNNLGSVYVDCGKLDLAAECYINALKIGHTRAHQGLARVHFLRNNRIGAYDEMTKLIEKARNNASAYEKRSEYCDRELTKADLQMVTKLDPLRVYPYRYRAAVLMDNHKEKEAIEELTKAIAFKADLNLLHLRAAFHEHIGDVSSALRDCRAALSVDPTHQEMLELHHRVNSQEP

SEQ ID NO: 3562 - protein, 886 aa, Oryza sativa
MRKLFFSELTSCKETKLHSAPHSWLPLEKGKLSKFAGHSTSSIESLMKMPEPVVLPHFKPADYVDILAQIHEELESCPPDEKSCLYLLQFQVFRGLGEVKLSRRSLQSAWEKASTIHEKLIFGAWLKYEKKGEEPISDLLSSCGKCSQEFKLLDFVSQISTGSHEISYDDESDVFWGSPVVHFRIRDDMIACDRRKLAALSTPLYAMLNGGFRESHLEVIDMSRNGISSIGMRAISKFSLTGRLPYLSADAILEMLDFANKFCCNGLKDACERKLASFICSRQDAIDFMECALELGCSILAAACLQVLLNELPECLNDEQVVRIFSCASKQQRSTMAGNASFSLYCLLSEVSMSINATSDVTVTFLEKLVDSASDSRQKQLALHQLACTRLLRKDYAEAERLFNAAFTAGHLYSVVGLARLASMRGNKHFSLKLLDSVMSSRWPLGWMYQERALYLEGDNKLENLNKATELDPTLTYPYMFRAASLMKRQSVEAALMEINRILGFKLVLECLELRFCCYLALEDHRAALCDVQAILTLAPDYRMIGGRVSAKQLRMLVMENVEQWTTADCWMQLYDRWSSVDDIGSLSVIYQMLESDAAKGVLYFRQSLLLLRLNCPEAAMRSLQLAREHAASQHEQLVYEGWILYDTGHCEEGLQKAEASIAIQRSFEAFFLKAYALADSSLDPSTSATVVSLLEDALRCPSDRLRKGQALNNLGSVYVDCGKLDLAAECYINALKIGHTRAHQGLARVHFLRNSRTGAYEEMTKLIEKARSNASAYEKRSEYCDRELTKSDLQMVTKLDPLRVYPYRYRAAVLMDNHKEKEAIAELTKAIAFKADLNLLHLRAAFHEHVGDISSALRDCRAALSVDPNHQEMLELHHRVNSQEP

SEQ ID NO: 3563 - protein, 888 aa, Brachypodium distachyon
MRKLFFSELTSCKETKLQSATHSWLPLEKGKLCKFTGHSSSSSSIESLMKMPEPAVLPHFKPADYVDILAQIHEQLEYCAPDEKSCLYLLQFQVFRGLGEAKLSRRSLQAAWEKASTIHEKLIFGAWLKYEKKGEEPISDLLGSCGKCSQEFKLLDFVSQISAESHGLSYDDESDEFQGSPVVHFRIKDDMIAGDRRKLAALSTPLYAMLNGGFRESHLEVIDMSRNGISPIGMRAISKFSLSGRLPYLSAEAILEMLDFANKFCCKGLKDACERKLASFVCTRQDAVDFMECAIELGCSILAASCLQVLLNELPECLNDEQVVRIFSSANKQQRSTMAGNASFSLYCLLSEVSMSISATSDVTISFLEKLVESASDSRQKQLALHQLACMRLLRKDHTEAERLFNAAFNAGHHYSVVGLARLASLRSNKHFSLKLLDSVMSSRWPLGWMYQERALYLDGDSKLENLNKATELDPTLTYPYMFRAASLMKRQSVEAALMEINRILGFKLVLECLELRFCCYLALEDYRAALCDVQAILTLAPDYRMIGGRVAAKQLRMLVMENVEQWTTADCWMQLYDRWSSVDDIGSLSVIYQMLESDAAKGVLYFRQSLLLLRLNCPEAAMRSLQLAREHAASQHERLVYEGWILYDTGHCEEGLQKAEASIAIQRSFEAFFLKAYALADSSLEPSTSATVVSLLEDALRCPSDRLRKGQALNNLGSVYVDCGKLDLAAECYINALKIGHTRAHQGLARVHFLRNNRTGAFEEMTKLIEKARSNASAYEKRSEYCDRDLTKADLQMVTKLDPLRVYPYRYRAAVLMDNHKEKDAISELTKAIAFKADLNLLHLRAAFHEHVGDISGALRDCRAALSVDPNHQEMLELHHRVNSQEP

SEQ ID NO: 3564 - protein, 888 aa, Secale cereale
MRKLFFSELTSCKETKLQSATHSWLPMDKGKLSKFAGHSSSSSSIESLMKMPEPPVLPHFKPADYVDILAQIHEELEYCPPDEKSCLYLLQFQVFRGLGEAKLSRRSLQAAWEKASTIHEKLIFGAWLKYEKRGEEPISDLLGSCGKCSQEFKLLDFVSQISAESHGISFEDESDEFQGSPVVHFRIRDDMIACDRRKLAALSTPLYAMLNGGFKESHLEVIDMSRNGISPIGMRAISKFSLSGRLPYLSAEAILEMLDFANKFCCKGLKDACEQKLASFVSSRQDAIDFMECAIELGCSILAASCLQVLLNELPECLNDEQVVRIFSSANKQQRSTMAGNASFSLYCLLGEVSMTIGATSDVTVSFLEKLVDSASDSRQKQLSLHQLACVRLLRKDHAEAERLFNAAFTAGHVYSVVGLARLASLRSNKHYSLNLLDSVMSSRWPLGWMYQERALYLDGDSKLENLNKATELDPTLTYPYMFRAASLMKRQSVEAALMEINRILGFKLVLECLELRFCCYLALEDYRAALCDVQAILTLAPDYRMIGGRVAAKQLRTLVMENVEQWTTADCWMQLYDRWSSVDDIGSLSVIYQMLESDAAKGVLYFRQSLLLLRLNCPEAAMRSLQLAREHAASQHERLVYEGWILYDTGHCEEGLQKAEASIAIQRSFEAFFLKAYALADSSLEPSTSATVVSLLEDALRCPSDRLRKGQALNNLGSVYVDCGNLDLAAECYINALKIGHTRAHQGLARVHFLRNNRTGAFEEMTKLIEKARSNASAYEKRSEYCDRDLTKADLQMVTKLDPLRVYPYRYRAAVLMDNHKEKDAISELTKAIAFKADLNLLHLRAAFHEHVGDISGALRDCRAALSVDPNHQEMLELHHRVNSQEP

SEQ ID NO: 3565 - protein, 889 aa, Triticum aestivum
MRKLFFSELTSCKETKLQSATHSWLPMDKGKLSKFTGHSSSSSSSIESLMKMPEPPVLPHFKPADYVDILAQIHEELEYCPPDEKSCLYLLQFQVFRGLGEAKLSRRSLQAAWEKASTIHEKLIFGAWLKYEKRGEEPISDLLGSCGKCSQEFKLLDFVSQISAESHGISYDDESDEFQGSPVVHFRIRDDMIACDRRKLAALSTPLYAMLNGGFKESHLEVIDMSRNGISPIGMRAISKFSLSGRLPYLSAESILEMLDFANKFCCKGLKDACEQKLASFVSSRQDAIDYMECAIELGCSILAASCLQVLLNELPECLNDEQVVRIFSSANKQQRSTMAGNASFSLYCLLGEVSMSISATSDVTVSFLEKLVDSASDSRQKQLSLHQLACVRLLRKDHAEAERLFNAAFTAGHVYSVVGLARLASLRSNKHYSLNLLDSVMSSRWPLGWMYQERALYLDGDSKLENLNKATELDPTLTYPYMFRAASLMKRQSVEAALMEINRILGFKLVLECLELRFCCYLALEDYRAALCDVQAILTLAPDYRMIGGRVAAKQLRTLVMENVEQWTTADCWMQLYDRWSSVDDIGSLSVIYQMLESDAAKGVLYFRQSLLLLRLNCPEAAMRSLQLAREHAASQHERLVYEGWILYDTGHCEEGLQKAEASIAIQRSFEAFFLKAYALADSSLEASTSATVVSLLEDALRCPSDRLRKGQALNNLGSVYVDCGNLDLAAECYINALKIGHTRAHQGLARVHFLRNNRTGAFEEMTKLIEKARSNASAYEKRSEYCDRDLTKADLQMVTKLDPLRVYPYRYRAAVLMDNHKEKDAISELTKAIAFKADLNLLHLRAAFHEHVGDISGALRDCRAALSVDPNHQEMLELHHRVNSQEP

SEQ ID NO: 3566 - protein, 817 aa, Pennisetum glaucum
IHEELDSCPPDEKSCLYLLQFQVFRGLGEAKLSRRSLQSAWEKASTIHEKLIFGAWLKYEKKGEEAISDLLSSCGKCSQEFRLLDFVSQVSTGSHDMSYDDDESEFRGSAVVHFRIRDDMIACDRRKLAALSTPLYAMLNGGFRESYLEVIDMSRNGISPIGMRAISKFSLSGRLPYLSADAILEMLDFANKFCCKGLKDACERKLASFVSSRQDAIDFMECALELGCSILAASCLQVLLNDLPECLNDEQVVRIFSSANKQQRLTMAGNASFSLYCFLSEVSMSTNPTSDVTVSFLEKLVESASDSRQKQLALHQLACSKFLRKDYAEAERLFNAAFSAGHFYSVVGLARLASLRGNKHFALKLLDSVMSSRWPLGWMYQERALYLDGDSKLEYLNKATELDPTLTYPYMFRAASLMKRQSVEAALMEINRILGFKLVLECLELRFCCYLALEDYRAALCDVQAILTLAPDYRMIGGRVAAKQLRMLVLENVEQWTTADCWMQLYDRWSSVDDIGSLSVIYQMLESDTAKGVLYFRQSLLLLRLNCPEAAMRSLQLAREHAASDHERLVYEGWILYDTGHCEEGLQKAEASIAIQRSFEAFFLKAYALADSSLDPSTSATVVSLLEDALRCPSDRLRKGQALNNLGSVYVDCGKLDLAAECYINALKIGHTRAHQGLARVHFLRNNRTGAYDEMTKLIEKARNNASAYEKRSEYCDRELTKADLQMVTKLDPLRVYPYRYRAAVLMDNHKEKEAIAELTKAIAFKADLNLLHLRAAFHEHIGDISSALRDCRAALSVDPNHQEMLELHHRVNSQEP

SEQ ID NO: 3567 - protein, 698 aa, Triticum aestivum
MIACDRRKLAALSTPLYAMLNGGFKESHLEVIDMSRNGISPIGMRAISKFSLSGRLPYLSAESILEMLDFANKFCCKGLKDACEQKLASFVSSRQDAIDYMECAIELGCSILAASCLQVLLNELPECLNDEQVVRIFSSANKQQRSTMAGNASFSLYCLLGEVSMSISATSDVTVSFLEKLVDSASDSRQKQLSLHQLACVRLLRKDHAEAERLFNAAFTAGHVYSVVGLARLASLRSNKHYSLNLLDSVMSSRWPLGWMYQERALYLDGDSKLENLNKATELDPTLTYPYMFRAASLMKRQSVEAALMEINRILGFKLVLECLELRFCCYLALEDYRAALCDVQAILTLAPDYRMIGGRVAAKQLRTLVMENVEQWTTADCWMQLYDRWSSVDDIGSLSVIYQMLESDAAKGVLYFRQSLLLLRLNCPEAAMRSLQLAREHAASQHERLVYEGWILYDTGHCEEGLQKAEASIAIQRSFEAFFLKAYALADSSLEPSTSATVVSLLEDALRCPSDRLRKGQALNNLGSVYVDCGNLDLAAECYINALKIGHTRAHQGLARVHFLRNNRTGAFEEMTKLIEKARSNASAYEKRSEYCDRDLTKADLQMVTKLDPLRVYPYRYRAAVLMDNHKEKDAISELTKAIAFKADLNLLHLRAAFHEHVGDISGALRDCRAALSVDPNHQEMLELHHRVNSQEP

SEQ ID NO: 3568 - protein, 840 aa, Triticum aestivum
MKMPEPPVLPHFKPADYVDILAQIHEELEYCPPDEKSCLYLLQFQVFRGLGEAKLSRRSLQAAWEKASTIHEKLIFGAWLKYEKRGEEPISDLLGSCGKCSQEFKLLDFVSQISAESHGISYDDESDEFQGSPVVHFRIRDDMIACDRRKLAALSTPLYAMLNGGFKESHLEVIDMSRNGISPIGMRAISKFSLSGRLPYLSAESILEMLDFANKFCCKGLKDACEQKLASFVSSRQDAIDYMECAIELGCSILAASCLQVLLNELPECLNDEQVVRIFSSANKQQRSTMAGNASFSLYCLLGEVSMSISATSDVTVSFLEKLVDSASDSRQKQLSLHQLACVRLLRKDHAEAERLFNAAFTAGHVYSVVGLARLASLRSNKHYSLNLLDSVMSSRWPLGWMYQERALYLDGDSKLENLNKATELDPTLTYPYMFRAASLMKRQSVEAALMEINRILGFKLVLECLELRFCCYLALEDYRAALCDVQAILTLAPDYRMIGGRVAAKQLRTLVMENVEQWTTADCWMQLYDRWSSVDDIGSLSVIYQMLESDAAKGVLYFRQSLLLLRLNCPEAAMRSLQLAREHAASHHERLVYEGWILYDTGHCEEGLQKAEASIAIQRSFEAFFLKAYALADSSLEASTSATVVSLLEDALRCPSDRLRKGQALNNLGSVYVDCGNLDLAAECYINALKIGHTRAHQGLARVHFLRNNRTGAFEEMTKLIEKARSNASAYEKRSEYCDRDLTKADLQMVTKLDPLRVYPYRYRAAVLMDNHKEKDAISELTKAIAFKADLNLLHLRAAFHEHVGDISGALRDCRAALSVDPNHQEMLELHHRVNSQEP

SEQ ID NO: 3569 - protein, 475 aa, Secale cereale
MECAIELGCSILAASCLQVLLNELPECLNDEQVVRIFSSASKQQRSTMAGNASFSLYCLLGEVSMSISATSDVTVSFLEKLVDSASDSRQKQLALHQLACVRLLRKDHAEAERLFNAAFTAGHVYSVVGLARLASLRSNKHYSLNLLDSVMSSRWPLGWMYQERALYLDGDSKLENLNKATELDPTLTYPYMFRAASLMKRQSVEAALMEINRILGFKLVLECLELRFCCYLALEDYRAALCDVQAILTLAPDYRMIGGRVAAKQLRALVMENVEQWTTADCWMQLYDRWSSVDDIGSLSVIYQMLESDAAKGVLYFRQSLLLLRLNCPEAAMRSLQLAREHAASQHERLVYEGWILYDTGHCEEGLQKAEASIAIQRSFEAFFLKAYALADSSLEPSTSATVVSLLEDALRCPSDRLRKGQALNNLGSVYVDCGNLDLAAECYINALKIGHTRAHQGLARVHSLGITGQVHSRK

SEQ ID NO: 3570 - protein, 786 aa, Triticum aestivum
LSRRSLQAAWEKASTIHEKLIFGAWLKYEKRGEEPISDLLGSCGKCSQEFKLLDFVSQISAESHGISYDDESDEFQGSPVVHFRIRDDMIACDRRKLAALSTPLYAMLNGGFKESHLEVIDMSRNGISPIGMRAISKFSLSGRLPYLSAESILEMLDFANKFCCKGLKDACEQKLASFVSSRQDAIDYMECAIELGCSILAASCLQVLLNELPECLNDEQVVRIFSSANKQQRSTMAGNASFSLYCLLGEVSMSISATSDVTVSFLEKLVDSASDSRQKQLALHQLACVRLLRKDHAEAERLFNAAFTAGHVYSVVGLARLASLRSNKHYSLNLLDSVMSSRWPLGWMYQERALYLDGDSKLENLNKATELDPTLTYPYMFRAASLMKRQSVEAALMEINRILGFKLVLECLELRFCCYLALEDYRAALCDVQAILTLAPDYRMIGGRVAAKQLRTLVMENVEQWTTADCWMQLYDRWSSVDDIGSLSVIYQMLESDAAKGVLYFRQSLLLLRLNCPEAAMRSLQLAREHAASQHERLVYEGWILYDTGHCEEGLQKAEASIAIQRSFEAFFLKAYALADSSLEPSTSATVVSLLEDALRCPSDRLRKGQALNNLGSVYVDCGNLDLAAECYINALKIGHTRAHQGLARVHFLRNNRTGAFEEMTKLIEKARSNASAYEKRSEYCDRDLTKADLQMVTKLDPLRVYPYRYRAAVLMDNHKEKDAISELTKAIAFKADLNLLHLRAAFHEHVGDISGALRDCRAALSVDPNHQEMLELHHRVNSQEP

SEQ ID NO: 3571 - protein, 635 aa, Panicum virgatum
MCSAPGNGGKEGPAAFSVDLAAAARRLLAFLRAAPPGVGPRSVRRYEEHWLPLAAAEGGGPGGEAAMLLLPPPDVQLVWLCHCFHHESYSAYCLSRFGRLIDRPSILDTENEEYAEDRCRDVWAAHYPSEPFDLCSNEFDGNSVDEIACDGANSEIVEMVRCYAGLAARFVSPFVREGVYHVAAWRRYVRFLDLIKKVGCTTQEHIRLVPSLDILLMWLAHQSFPVSYAKDMTTMTIMENVAKVGLSYGEMVSDEEVERTRALWEDAYNEPYDMAGSEIDVGAVSAAREAFYWAPAASEEDANRLYKILQPRFLMEVYVFLKGDIDKEHINKEFLRLRTQRSHRSLKLNKSMVNLSCKNWQKTWHLYCEFATRGVVIEVRRTTSGCFRNSKFLKSISFSWSDMLHEKALALTEELEVGMRAMASITPPVQAPYLLKCVPDRVTDDGGAMISDVILRMRNYRPQEGRWLTRTVLDHGGRECFVVRMRIGRGIWRRGAETPVAVKWEDRSIEVREGSWSYVASTSSVGYAPEKVVGTATAMKDQQENKVVWRLSTGDILTICLGDELSFQLKNEKLEEEARLLVGRRLSYKVNTDGVSSNHAEEEQYITLVRKSPDHHGDRATVLINWKLLDRGVLT

SEQ ID NO: 3572 - protein, 736 aa, Setaria italica
MSSALGVGGKEGPSAFSVDLVAAARRLLAFLRAGPPGVGRRSVRRYEELWLPLAVAEGGEGGGGGGEAPMLVPPPDVHLVWLCHCFHHESYSVYCLSRFGRLIDRPSILDAENEEYAEERCRDVWAAHYPSEPFDLHRNEIDGNSDDDIAYANANSEIVEMVRRYAGLAAHFASPFVREGVYHVAARRRYVCFLDLMKKVVGTTQDQTRLVPSLDILLMWLAHLSFPASYATDMVAMAISDNIAKMGVGYGEVVTDEVLKRTRALWEEAYDVPYDMAGSEVEMAAVRAAREAFYWAPAASDEDANRLYKSLQPRFLMEVYVFLKGESDKEHINKEFLRLRTQRCHRSLKLNKSMANLSCKNWQKTWHLYCEFATRGLLIEVRRTTTGCFRNSKFLKNISFSWSDMLHEKALALTEELEVRMRAMASITPPVQAPYLLKCVPDRVTDDGGAMISDVILRMRNYRPQEGRWLTRTVLDHGGRECFVIRMRIGRGIWRRGAETPVAVKWEDRSIEVREGSWSYVASTSSIGYAPEKVVGTATATKDQQENKVVWSLSTGYILTVNLGDELSFQLKSESLEEEARLLVGRRLSYRVNTDGASSNHNEEEQYLTLVRNSPDHHGDRATVLLNWKLLAVEFQPEEDAVFVLLLCMVIARTMTEIRREDVAGLLVRRRIGEARVGQRDWGSVMLPDLLSPDPNLQPWYRNAAQVLSSAETGAMLAKYSPADGKDVLYRQSLIP

SEQ ID NO: 3573 - protein, 411 aa, Panicum virgatum
MAKARAHSSKRTTHHLLLAVSLSVCVLLPLLLPAAATAAVAVAEGDGEIKSALGAGRQWVTGKDEVNLVAEGDTARVGLVEEDEFAGGFGSLDSMLQWAIGNSDPEKLKEEAADVQKLSADELLKRRQEIKELMEKLKMPSDADLMKIAIADLKNSSISLEDRQRALQELLVLVEPIDNANDLDKLGGLLPVIQELNNANEEIRTTSAWVLGTASQNNALVQNQILDYGALVRLVKMGYSTSTEEAAKALYAISALIRNNVNGQEAFHSENGGSMLQHILVSNSIDVRLQKKAVFLVTDLADFQLNSGNPQLPFLSDRLFLKSMVDMLSNFDLDLHEKVLLAIKSLLKLSSTDVEDFEFYDLEGVLLRLGVQLEDLTPEDQKEFAAEVDGLRREVQTLFQQKLKQGKATAT

SEQ ID NO: 3574 - protein, 411 aa, Panicum virgatum
MAKARAHSSKRTTHHLLLAVSLSVCVLLPLLLPAAATAAVAVAEGDGEIKSALGAGRQWVTGKDEVNLVAEGDTARVGSVEEDEFAGGFGSLDSMLQWAIGNSDPEKLKEEAADVQKLSADELLKRRQEIKELMEKLKMPSDADLMKIAIADLKNSSISLEDRQRALQELLVLVEPIDNANDLDKLGGLLPVIQELNNANEEIRTTSAWVLGTASQNNALVQNQILGYGALVRLVKMGYSTSTEEAAKALYAISALIRNNVNGQEAFHSENGGSMLQHILVSNSIDVRLQKKAVFLVTDLADFQLNSGNPQFPFLSDRLFLKSMVDMLSNFDLDLHEKVLLAIKSLLKLSSTDVEDFEFYDLEGVLLRLGVQLEDLTPEDQKEFAAEVDGLRREVQTLFQQKLKQGKATAT

SEQ ID NO: 3575 - protein, 879 aa, Panicum virgatum
MATAATASHPASASTSGRDALAAACSSPAAVCLVPFRWWARVREEEAAGGVRYAATAAASPSYYGLRLLHSFLHPDLVLRLERGDGRAGGTGAGGRSYALVPADELSRALARQNSGFGLQNKHSFAGDSAGAYPLVLRISVRETSILTLKISKKDNPVENYKRANKIFNVDSQPVHVWDFSGQTNLILMNEWNRLHHDCCHADQENLLEVQVYAMSDSLTSKIGGTNKESPGGVNDLNADSYYRSFGRAGSMGLIGLENLGNTCFMNSSIQCLAHTPKLVDYFLGDYARNINRTNPLGLNGELALAFGELLRSLWTTDRKPVAPHHFKEKIACFAPQFSGFNQHDSQELLAFLLDGLHEDLNQVKCKPYEEAKDASGRPDEEVADEYWSNHLARNDSVIVDTCHGQYKSMLTCPTCSKKSVTFDPFMYLSLPVPSMAKRAMTVTVFSTDGSREPCSYDVSVPKFGTLSDLVQALSIACLLGDDEILLVAEVYNNCILRYLEEPSDSVSLLRDGDKLAAYRLPKKYEKSPLVIFTHQHFDEHSSGDNVTPQKKEFEAPLLAALPERVNGLSLQNIYLKLLNPFQLSKGASSLNGSAGFNGDSADLMDGMPSDSGSNFQDIQLDDDPRNSNCSTNDCEITNAPGELYDGGKADPNKERRVEDFEFYLKSERGDVQQQKIEINELDLLETIPSRLHVNVHWQQNASRQYAASMLNNLPEIHKLELTPKGTEDSIALHGCLEAFLKEEPLGPEDMWYCPCCKKHQQAMKKLDLWRLPEVLVIHLKRFSYTQFTRNKLETFVDFPTTDLDLSSYVADKSEQPSSHYRLYAISNHYGNMGGGHYTASIYHEEGKGWYKFDDDCVTPISEDSIKTPAAYVLFYRRQ

SEQ ID NO: 3576 - protein, 881 aa, Panicum virgatum
MATAATASHRASASTSGRDALAAASSAPAAVCLVPFRWWARVREEEAAGGVRYAATAAASPSYYGLRLLHSFLHPDLVLRLERGDGRAGGAGGGAGGRSYALVPADELSRALARQNSGFGLQNKHSFAGDSAGAYPLVLRISVRETSILTLKISKKDNPVENYKRANKIFNVDSQPVHVWDFSGQTNLILMNEWNRLHHDCCHADQENLLEVQVYAMSDSLTSKIGGTNKESSRDVNDLNADSYYRSFGRAGSMGLIGLENLGNTCFMNSSIQCLAHTPKLVDYFLGDYARNINRTNPLGLNGELALAFGELLRSLWTTDRKPVAPHHFKEKIACFAPQFSGFNQHDSQELLAFLLDGLHEDLNQVKCKLYEEAKDASGRPDEEVADEYWSNHLARNDSVIVDTCHGQYKSTLTCPTCNKKSVTFDPFMYLSLPVPSTAKRAMTVTVFSTDGSREPCSYDVSVPKFGTLSDLVQALSIACLLGDDEILLVAEVYNNCILRYLEEPSDSVSLLRDGDKLVAYRLPKKYEKSPLVIFTHQHFDEHSGGDNVTPQKKEFEAPLLAALPERVNGLSLQNIYLKLLNPFHLSKGDSSLNGSAGSTGDSADLMDGMPSDSGSNFQDIQFEDDPGSSNCSTNECEIITKAPGEYDGGKADPNKERRVEDFEFYLKSERADVQQQKIEINELDLLKTIPSRLHVNVHWQQNASRQYTASMLNNLPEIHKLELTLKGTEDWVALHGCLEAFLKEEPLGPEDMWYCPCCKKHQQAMKKLDLWRLPEVLVIHLKRFSYTQFTRNKLETFVDFPTTDLDLSSYIADKSEQPSSHYHLYAISNHYGNMGGGHYTASIYHEEGKGWYKFDDDCVTPISDDGIKTPAAYVLFYRRQ

SEQ ID NO: 3577 - protein, 868 aa, Setaria italica
GCELPGVWLDSATDFDNAACRWWARVREEEAAGGVRYAATAAASPSYYGLRLLHSFLHPDLVLRLERGDGRAGAGAGGGSGGGGRSYALVPADELSRALARQNSGFGLQNKHSFAGDSAGAYPLVLRISVRETSILNLRISKKDNPVENYKRANKIFNVDSQPVHVWDFSGQTNLILMNEWNRLHHDCCHADQENLLEVQVYAMSDSLTSKIGGTNKENSGDVDDLSADSSYRSFGRAGSMGLIGLENLGNTCFMNSSIQCLAHTPKLVDYFLGDYARNINRTNPLGLNGELALAFGELLRSLWTTDRKPIAPHHFKEKIACFAPQFSGFNQHDSQELLAFLLDGLHEDLNQVKCKPYEEAKDASGRPDEEVADEYWSNHLARNDSVIVDTCHGQYKSTLTCPTCSKTSVTFDPFMYLSLPVPSTAKRTMTVTVFSTDGIREPCSYDVSVPKFGTLSDLVQALSIACLLGNDEILLVTEVYNNCIIRYLEEPSDSVSLLRDGDKLAAYRLPKKYEKSPLVVFTHQHMDEYSSGDNVTPQKKEFEAPLLATLPETVNGLLLQDIYLKLLNPFQLSKGANSLSGFAGSNGDPVDLMDGMPSDSDSNFQNIQLEDDTESSNCSTTDCEIRKGPSELYDMGTADSDKGANVEEFEFYLKNERGDGQQQKIDINEVDLLETIPSRLHVNVHWQQSASRQYDTSMLNNLPEIHKLELIPKGTEDSVALHGCLEAFLKEEPLGPEDMWYCPCCKKHQQAMKKLDLWRLPEVLVIHLKRFSYTQFTRNKLETFVDFPTTDLDLSCYIANKSEQPSSHYHLYAISNHYGNMGGGHYTASIYHEEGKGWYKFDDECVTPISEDGIKTSAAYVLFYRRE

SEQ ID NO: 3578 - protein, 395 aa, Sorghum bicolor
MAGDPGDAPEVGEGGIRSVLTMGSLVDPSGNEVQFPEIDGKMIGLYFAANWYPKCEAFTPVLAAAYEQLKERGAGFEVVLVSCDEDRPSFERFHRTMPWPAVPFGDLRCKKRLSERFQVEGIPRLVVLAADGAVVHPDAADLVHRYGERAFPFTAAKVAELEADDQRKYASQTLEKLFSINGKEYVNGANEQVPISSLVGKTVGLYFSANHCAPCIKFTTKLAAIYSSLKGKAEDFEIVYVPMDKEEDGYLRSCRDMPWLALPYDGVPSRALARYFDVREIPTLVVVGPDGKTVTRDGRNLVNLYFDMAFPFTDAQIRLLQEAEDEAAKEYPQSLRHRGHRHELSIVSDKSGGGPYICCECEEQGLGWAYQCIACGYEIHLRCGQNAEGGGAGTA

SEQ ID NO: 3579 - protein, 397 aa, Setaria italica
MAGVLLEVEEAPEGGGGIRSVLTMGSLVSPSGNEVHFPELDGKIIGLYFAANWYPKCEAFTPVLAAAYQHLKERGAGFEVVLVSCDEDRPSFERFHRTMPWPAVPFGDLQCKKRLSERFQVEGIPRLVVLAPDGEVVHPDAADLVHRYGERAFPFTAARVAELEADDQHKYASQTLEKLFSIDGKEFVNGGNEQVPISSLVGKTVGLYFSAHQCAPCMKFTAKLAAIYRSLKGRAKDFEIVYIPMDKEEDGYLRSCSDMPWLALPYDGAPSRALARYFDVREIPTLVVVGPDGKTVTRDGRNLVNLYFDMAFPFTDAQIRQLQEAEDEAAKGYPQSLRHRGHRHELSIVSEKSGGGPYICCECEEQGLGWAYQCIACGYEIHLRCGRNAEGGSAGTG

SEQ ID NO: 3580 - protein, 393 aa, Panicum virgatum
MAGVPEADEAAEGGGGIRSVLTMGSLVSPSGNEVHFAELDGKIIGLYFAANWYPKCEAFTPVLAAAYQQLKARGAGFEVVLVSCDEDRPSFERFHRTMPWPAVPFGDLQCKKRLSGRFQVEGIPRLVVLAPDGEVVHPDAADLVHRYGEGAFPFSAARVAELEADDQRKYASQTLEKLFSVDGIKKEFVTGGNGQVPISSLVGKTVGLYFSAHQCAPCMKFTAKLAGMYSSLKGKAEDFEIVYVPMDKEEDGYLRSCSDMPWLALPYDGAPSRALARYFDVREIPTLVVVGPDGKTVTRDGRNLVNLYFDMAFPFTDAQIRLRQEAEDKAAKGFPQSLRHRGHRHELSIVSEKSGGGPYICCECEEQGLGWAYQCIACGYEIHLRCGGSAGTG

SEQ ID NO: 3581 - protein, 303 aa, Panicum virgatum
MPWPAVPFGDLQCKKRLSERFQVEGIPRLVVLAPDGEVVHPDAADLVHRYGETAFPFSAARVAELEADDQRKYASQTLEKLFSMDGIGKEFVTGRNGQVPISSLVGKTVGLYFSAHQCAPCMKFTEKLAAIYSSLKGKAEDFEIVYVPMDKEEDGYLRSCGDMPWLALPYDGAPSRALARYFDVREIPTLVVLGPDGKTVTRDGRNLVNLYFDMAFPFTDAQIRLLQEAEDEAAKGFPQSLRHRGHRHELCIVSEKSGGGPYICCECEEQGLGWAYQCIACGYEIHLRCGRDRDEEGGSAGTG

SEQ ID NO: 3582 - protein, 296 aa, Saccharum officinarum
MAFSSSLAPFFAPSGTFGAHPAKRLRADAPGRFVASSSPPPDVVVTREQGKNARLIAALEKHNIHSLELPLIKHVEGPDTDRLSDVLRNDKFDWITITSPEAAAVFLQGWKAAGSPKVRVAVVGAGTARVFHEVSESDDQSLEVAFSPSKALGKVLASELPRSNENSCKVLYPASAKAGHEIQDGLSERGFDVTRLNTYTTVPVEDVEPLTLNLAISAPVVAVASPSALRAWLNLISKVDNWNNSVACIGETTASAAKKLGLKSIYYPTTPGLEGWVESILEALRVHRTSKEAPRC

SEQ ID NO: 3583 - protein, 299 aa, Sorghum bicolor
MAFSSSLAPFFAPSGTFGARPEKRLRADAPGRFVASSSPPPDVVVTREQGKNARLIAALEKHNIHSLELPLIKHVEGPDTERLSDVLRNDKFDWITITSPEAAAVFLQGWKAAGSPKVRIAVVGAGTARVFHEVSESDDQSFEVAFSPSKALGKVLASELPRSNENSCKVLYPASAKAGHEIQDGLSERGFDVTRLNTYTTVPVEDVEPLTLNLAISAPVVAVASPSALRAWLNLISKVDSWNNSIACIGETTASAAKKLGLKSIYYPTTPGLEGWVDSILEALRVHRTSKEVLLFPFQ

SEQ ID NO: 3584 - protein, 296 aa, Setaria italica
MAFSSSLAFPFPSPPSGQARPAGRLRAGATGRLLGCSSPPPDVVVTRERGKNAKLIAALEKHNIQSLELPLIKHVDGPDTYRLPDVLRNDKFDWITISSPEAAAVFLQGWKAAASPKVRVAVVGAGTAKVFDEVSQSDDQSLEVAFSPSKAMGKVLASELPRGSESTCKVLYPASAKASREIQDGLSDRGFHVTRLNTYTTVPVEDVEPLTLKLAISAPVVAVASPSALKAWLKLISKVDNWNNSIACIGETTGSAAKKLGLKSIYYPTTPGLEGWVESILEALRVHRQLKEAPKC

SEQ ID NO: 3585 - protein, 424 aa, Sorghum bicolor
MYLVKDISGAIGLMAVALVLLGTWPVVLAVLERRGRLPQHTFLDFSVTNFLAAVLVALTFGQIGPDTPETPNFLTQLAQVQNNWPSVLFAMAGGVTLSLGTLATQYGWAFVGLSVTEVMASSLKVVIGTTLNYFLDGRINKAEILFPGVGCFLIAAILGSLVHASNAADNQEKLANSLAKYSKNTRKNTADDEDLTKHLLNKEIPKDPEAAKPDAADQATEAPEKVEAGTAEFLVNLEEKRSIKVLGSHTLLGLGIVVFAGVFYALFAPALNLSTNDQWHALPAGVPHLVVYTAYFYFSLACLAVSAALNVWLLYRPIMAGVPASSTVSAYLRDGGEGRAPAMLAGMVCGLGNAFTFMAGQAAGYAAADSVQALPLVSTFWGVVLFGEYRRSSRRTYTLLASMLLMFTVAMVLLMASSNHRKPL

SEQ ID NO: 3586 - protein, 415 aa, Setaria italica
MYLVKDISGAIGLMAVALVLLGTWPVVLAVLERRGRLPQHTFLDFSITNFLAAVLIALTFGQIGPDTPETPNFLTQLSQNNWPSVLFAMAGGVTLSLGTLATQYGWAFVGLSVTEVMASSLKVVIGTTLNYFLDGRINKAEVLFPGVGCFLVAAILGSLVHSSNAIDNQEKLANSGVVNYSKNTRNSAYEDLAEHLLEKEGQKDLEEAKLDAPEAKLEKVQAGTAEFLVHLEEKRSIKVLGSNTLLGLGIVVFAGVFYALFTPAFNIATNDQWHALPAGVPHLVVYTAYFYFSLACFAVSVGLNVWLLYHPMVGVPRSTVAAYLRDGEGRGLALLAGMVCGLGNAFTFMAGQAAGYAAADSVQALPLVSTFWGVVLFGEYRRSSRRTYTLLASMLLMFAVAMVVLMASSNHRKPL

SEQ ID NO: 3587 - protein, 661 aa, Sorghum bicolor
MGVATVTELKQSISGKRTFRPSLISRHANEWPPTDVSSDLTVEVGTSSFALHKLFAQFPLVSRSGKIRRLVAEAKDAKLARLSLHGTPGGAPAFELAAKFCYGVHVDVTVANVAMLRCAAHYLQITDDFSDKSLELRAESFLRDAVLPSIASSVAVLRSCEALLPAAEDVGLVPRLIAAIATNVCKEQLTSGLSKLDQCAAQLKPAAAFAADLDSPGPGDWWGKSVAALGLDFFQRLLSAVKAKGLKQETVTRILINYAQNSLHGLMARDVHRCGAADADAVKKQRAVVEAIVGLLPAQSKKSPVPMAFLSGLLKTAMAVSASSICRADLEKRIGMQLDQAILEDILIAAGAGAGAATPAGHGQQHALYDTDVVARIFSVFLNLDDDHNEEDAAAFDYDSPRSPKQSLLVKAAKLLDSYLAEVALDSNILPSKFISLAELLPDHARVVTDGLYRAVDIFLKVHPNIKEAERYRLCKAIDCQRLTPDACSHAAQNERLPVQMAVQVLYFEQLRLRSAIQASGGGGSMGGHDAALFFGCAAAAAASSVSVQGSVNMRSGSGVGSGAMSPRDNYASVRRENRELKLEVARMRMRLTDLEKDHVSMKRELVRVGPANRLLRGFARSLSRLFRMRPAAEPGLQQLGAKATADAKVLFQRRRRHSIS

SEQ ID NO: 3588 - protein, 650 aa, Panicum virgatum
MGVATVTELKQSISGKRTFRPSLISRHANEWPPTDVSSDLTVEVGTSSFALHKFPLVSRSGKIRRLVAEAKDAKLARLSLHGTPGGAPAFELAAKFCYGVHVDVTVANVAMLRCAAHYLQMTEDFSDKNLEARAEAFLRDAVLPSIASSVAVLRSCEALLPAAEDVNLPARLIAAIASNVCKEQLTSGLSKLDQCAQLKPPAAFVAELDSPGDWWGKSVAGLGLDLFQRLLSAVKAKGLKQETVTRILINYAQNSLHGLMARDVHGAAKCGGGADADAVKKQRAVVETIVSLLPAQSKRSPVPMAFLSGLLKTAMAVSASSICRADLEKRIGMQLDQAILEDILIAAGAGAGAGTGTPAGQQHGLYDTDVVARIFSVFLNLDDDNEEDGGFDYDSPRSPKQSLLVKAAKLLDSYLAEVALDSNILPSKFISLAELLPDHARLVTDGLYRAVDIFLKVHPNIKEAERYRLCKAIDCQRLTPDACSHAAQNERLPVQMAVQVLYFEQLRLRSAIQAGGGGGSMGGGHDAALFFGCAAAAQGGVNMRSGSGVGSGAMSPRDNYASVRRENRELKLEVARMRMRLTDLEKDHVSMKRELVRVGPANRLLRGFARSLGRLFRMRPAAEPGLQQLGAKATADAKVLFQRRRRHSIS

SEQ ID NO: 3589 - protein, 658 aa, Setaria italica
MGVATVTELKQSISGKRTFRPSLISRHANEWPPTDVSSDLTVEVGTSSFALHKFPLVSRSGKIRRLVAEAKDAKLARLSLHGTPGGAQAFELAAKFCYGVHVEVTVANVAMLRCAAHYLQMTEDFSDKNLELRAEAFLRDAVLPSIASSVSVLRSCEALLPAAEDVNLVARLIAAIASNVCKEQLTSGLSKLDQCAQLRPAAAFVELDSPGDWWGKSVAGLGLDFFQRLLSAVKAKGLKQETVTRILINYAQNSLHGLMARDVHGGAKCGGGGADADAARKQRAVVEAIVGLLPAQSKRSPVPMAFLSGLLKTAMSVSASSICTADLEKRIGMQLDQAILEDILIAAGAGAGAATACGQLHGLYDTDVVARIFSVFLNLDDDSEEDGGFDYDSPRSPKQSLLVKAAKLLDSYLAEVALDSNILPSKFISLAELLPDHARLVTDGLYRAVDIFLKVHPNIKEAERYRLCKAIDCQRLTPDACSHAAQNERLPVQMAVQVLYFEQLRLRSAIQAGGGGGGMSMGGHDAALFFGCAAAAASAQGCGGVTNMRSGSGVGSGAMSPRDNYASVRRENRELKLEVARMRMRLTDLEKDHVSMKRELVRVGPANRLLRGFARSLSRLNALFRMRPAAEPGLQQLGAKATADAKVLFQRRRRHSIS

SEQ ID NO: 3590 - protein, 406 aa, Panicum virgatum
MGVATVTELKQSISGKRTFRPSLISRHANEWPPTDVSSDLTVEVGTSSFALHKFPLVSRSGKIRRLVAEAKDAKLARLSLHGTPGGAPAFELAAKFCYGVHVDVTVANVAMLRCAAHYLQMTEDFSDKNLEARAEAFLRDAVLPSIASSVAVLRSCEALLPAAEDANLVSRLIAAIAGNVCREQLASGLSKLDQCAQLVKPPAELDSPGEWWGKSVAGLGLDLFQRLLSAVKAKGLKQETVTRILINYAQNSLHGLMARDVHGAAKCQLRSGRRRYQEAARRRRDHREPAPGAVEEEPRADGLPLGAPQNGDGGVRVQHLQGRPREADRHAAGPGHPGGHPHRRRRRRRRRRWGCRAGRPAAARAVRHGRGGAHLLGVPEPRRRRRGGRRRVRLRQPAVPEAEPPG

SEQ ID NO: 3591 - protein, 653 aa, Panicum virgatum
MGVATVTELKQSISGKRTFRPSLISRHANEWPPTDVSSDLTVEVGTSSFALHKLFAQFPLVSRSGKIRRLVAEAKDAKLARLSLHGTPGGAQAFELAAKFCYGVPVDVTVANVAALRCAAHYLQMTEDFSDKNLEARAEAFLRDAVLPSIASSVAVLRSCEALLPAAEDANLVSRLIAAIAGNVCREQLASGLSKLDQCAQLVKPPAELDSPGEWWGKSVAGLGLDLFQRLLSAVKAKGLKQETVTRILINYAHNSLHGLMARDEHGGAGARCGADADAIRKQRAVVEAIVSLLPAQSRRSPVPMAFLSGLLKTAMAGSASSICRADLEKRIGMQLDQAILEDILIAAGAGAGAAAPGGQQQHGLYDTDVVARIFSVFLNLDDDAEEDGGGFDYDSPRSPKQSLLVKAAKLLDSYLAEVALDSNILPAKFISLAELLPDHARLVTDGLYRAVDIFLKVHPNIKEAERYRLCKAIDCQRLTPDACSHAAQNERLPVQMAVQVLYFEQLRLRSAIQAGGGGSMGGGPDAALFFGCAAAASQGGGVTNMRSGSGVGSGAMSPRDNYASVRRENRELKLEVVRMRMRLTDLEKDHVSMKRELVRVGPANRLLRGFARSLTRFFRMRPAAEPGLHQLGAKATADAKVLFQRRRRHSIS

SEQ ID NO: 3592 - protein, 661 aa, Hordeum vulgare
MGVATVTETKQSVSVSGKKMFRASLNNRHANEWPPTDVSSDLTVEVGTSSFALHKFPLVSRSGKIRRLVAEAKDAKLARLTLHATPGGAPAFELAAKFCYGVHVDITVANVAMLRCAARYLQMTDDFSDKNLELRTEAFLRDAVLPSIASSVAVLRTCEALLPAAEDVNLVARLIAAIANNVCKEQLASGLLSRLEQSAQLKPAAGIVELDSPGDWWGKSVAGLGLDLFQRLLSAVKSKGLRQETVTRILINYAQNSLYGLMAAEKCDGVMDTDAVKKQRAVVETIVGLLPAQSKKSPVPMAFLSGLLKTAMALSASSICKTDLEKRMGMQLDQAILEDILIATRSGEASTAGTGTVAAVQHHTLYDTDVVARIFSVFLNLDEDNEEEDGGCGGFDYDSPRSPKQSSIVKASKLLDSYLAEIALDSNLVPPKFISLAEILPDHARLVTDGIYRAVDIFLKVHPNIKEAERYRMCKAIDCQRLTPDACSHAAQNERLPVQMAVQVLYFEQIRLRSAIQSGGGGGGGVFGHDGAIFFGGTVSAATAQGSCSNMRSGSGVGSGAMSPRDNYASVRRENRELKLEVSRMRMRLTDLEKDHVSMKRELVRVNPANRLLRSFARSFGRLNTLFRMRPAAEPGLQQLGAKATADAKVLFQRRRRHSIS

SEQ ID NO: 3593 - protein, 671 aa, Oryza sativa
MGVATVTELRQSFSGKRALRPTLTSRHANEWPPTDVSSDLTVEVGTSSFALHKLLAQFPLVSRSGKIRRAVAEAKDGKLARLGLHGTPGGAAAFELAAKFCYGVGVDVTVGNVATLRCAAHYLQMTEDFSDKNLELRAEAFLRDAVLPSIAGSVAVLRSCEALLPAAEDVNLVPRLIAAIANNVCKEQLTSGLSKLDQLKPPPPPQAVVVAAAAAGDLDSPGDWWGKSVAGLGLDFFQRLLSAVKSKGLKQETVTRILINYAQNSLHGLMARDIAAAAKCGGGGGDTDAVKKQRAVVETIVGLLPAQSKKSPVPMAFLSGLLKTAMAASASSICRADLEKRIGMQLDQAILEDILVAAGPVSAAAAAAAVEHTLYDTDVVARIFAVFLNLDDDSNDEDAVVVGGGCGAFDYDSPRSPKQSLLVKASKLLDSYLAEIALDSNLLPSKFISLAELLPDHARLVTDGLYRAVDIFLKVHPNIKEAERYRMCKAIDCQRLTPDACSHAAQNERLPVQMAVQVLYFEQLRLRSAIQATGTTTTTTNTSIGGAHDAALFFGCAAAAAAPRSGSGVGSGAMSPRDSYASVRRENRELKLEVARMRMRLTDLEKDQVSMRRELVRVGPANRLLRGLARRLGSLFHFRGAAAEPGLQQLGAKATADAKVLFQRRRRHSIS

SEQ ID NO: 3594 - protein, 178 aa, Zea mays
MEPAADGNDVHGKRRDGGQHAPVVSLRALGLADADAFMAWASDREMRHLKQPLCATREQAMAHIRDTVLGHPWFRAVCVSDSPVGQVSVWPYADEGGRRANLGYALAHDQWGWGIAVAAVRMVVGRVFDDLPGLERLEAVTDVVNVRSQRVLEKVGFHREGCCAGTSPDAAAAGPEMR

SEQ ID NO: 3595 - protein, 223 aa, Sorghum bicolor
MEVQHQHQQQQGEGGAPAPAAELEVSLREFTLSDADAEAFMSWASDPRVVLFQRRDAYDHIDQARRYIADHVLPHPWYRAICAGTSAGAGAPLPVVGSISVKPAAPAEADDDGRLFRASVGYRVAHAHWGRGVATRAVRAAAAAVFAAWPWLLRLEAVADVDNPASQRVLEKAGFVREGVLRKYILLKGRPRDMVIFSIVVDTDTDTDRRQQQQQSDNKPDGP

SEQ ID NO: 3596 - protein, 201 aa, Panicum virgatum
MEPPAGDGDGDAQDRQRRDDGDAPAAAAPVVSLRPLGLADADAFMAWASDDRVMRFLKRPLCATREQAVAQIRDTVLGHPWFRVVCVGGRPVGQVSVWPYADEGGRRANIGYALARDHWGRGIAAAAIRMVVGRVFDDLPGLERLEAVTDVENVRSQRVLEKAGFQREGVLRRYIAGRGGGQARDAVIYSFLSSDRPPVRP

SEQ ID NO: 3597 - protein, 105 aa, Sorghum bicolor
MAERVSRLSTEKAVVIFTTSQCPMCHTVTSLLISELGVCAAVHELDKDPRGRDMERELARCLGRAPPVPAVFIGGRLVGSTDKIMSLHLAGKLVPMLKAAGAIWL

SEQ ID NO: 3598 - protein, 104 aa, Setaria italica
MAERVSRLSTEKAVVIFTTSQCPMCHTVSSLFSELGVCAAVHELDKDPRGREMERELARRLGRVPPVPAVFIGGKLVGSTDRVMSLHLAGNLVPMLKGAGAIWL

SEQ ID NO: 3599 - protein, 104 aa, Setaria italica
MAERVSRLSTEKAVVIFTRSQCPMCHTVLSLFSELGVCAAVHELDKDPRGRDMERELARRLGRAPPVPAVFVGGKLVGSTDTIMSLHLAGKLVPMLKAAGAIWL

SEQ ID NO: 3600 - protein, 104 aa, Panicum virgatum
MAERVSRLSTEKAVVIFTRSQCPMCHTVSSLFAELGVCAAVHELDKDSRGRDMERELARRLGRAPPVPAVFVGGNLVGSTDKVMSLHLAGKLVPMLKAAGAIWL

SEQ ID NO: 3601 - protein, 106 aa, Sorghum bicolor
MAERVSRLSTEKAVVIFTTSQCPMCHTVTSLLISELGVCAAVHELDKDPRGREMERELARRLGRAPPVVPVVFIGGRLVGSTDMIMSLHLANKLVPMLKAAGAIWL

SEQ ID NO: 3602 - protein, 104 aa, Panicum virgatum
MAERVSRLSTEKAVVIFTRSQCPMCHAMLSLFSELDVCAAVHELDKDPRGRDMERELARRLGRAPPVPAVFVGGNLVGSTDKVMSLHLAGKLVPMLKAAGAIWL

SEQ ID NO: 3603 - protein, 104 aa, Panicum virgatum
MAERVSRLSTEKAVVIFTRSQCPMCHTVLSLFSELDVCAVVHELDKDPRGRDMERELARRLGRAPPVPAVFVGGNLIGSTDKVMSLHLASKLVPMLKAAGAIWL

SEQ ID NO: 3604 - protein, 105 aa, Panicum virgatum
MAERVSRLSTEKAVVIFTRSPCPMCHTVLSLLISELSVCVAVHELDKDPRGRDMERELARRLGRSPPVPAVFIGGNLVGSTNKVMSLHLAGKFVPMLKAAGAIWL

SEQ ID NO: 3605 - protein, 105 aa, Zea mays
MAKRVSRLSKKAVVIFTTSQCPMCHTVWSLFQELGVCAAVHELDKDPRGPEMERELARRLGRAPSVVPAVFISGKLVGSTDKIMSLHLDGKLVPMLKGSGWDIWL

SEQ ID NO: 3606 - protein, 104 aa, Cynodon dactylon
MAERVAKLSTEKAVVIFTTSQCPMCHSVVSLFSDLSVSAAVHELDKDPRGREMERELARRLGRSPPVPAVFIGGKLVGSIDKIMSLHLAGKLMPMLMAAGAIWV

SEQ ID NO: 3607 - protein, 104 aa, Triticum aestivum
MERVTRLSTEKAVVIFTPSNDCPMSYTVTTLFSGLGVCAAVHELDKDPRGRDMERDLARRLGRTPPVPAVFIGGKLVGSTDRVMSLHLGGKLVPMLKAAGAIWL

SEQ ID NO: 3608 - protein, 104 aa, Unknown
  Sequence found in Organisms: Hordeum vulgare, Secale cereale
MERVTRLSTEKAVVIFTPSNDCPMSYTVTTLFSGLGVCAAVHELDKDPRGRDMERDLARRLGRTPAVPAVFIGGKLVGSTDRVMSLHLGGKLVPMLKAAGAIWL

SEQ ID NO: 3609 - protein, 104 aa, Oryza sativa
MERVAKLSTEKAVVIFTASNCPMCHTVVSLFSDLGVGAAVHELDRDPLHGRDMERDLARRLGRSPPVPAVFIAGKLVGSTDRVMSLHLAGKLVPMLKAAGAIWL

SEQ ID NO: 3610 - protein, 104 aa, Brachypodium distachyon
MERVTKLSSEKAVVIFTASEYPMCHTVTSLFSDLGVAAAEHELDKDPRGREMERDLARRLGGRAPPVPAVFIGGKLVGSTDRVMSLHLGGKLVPMLKAAGAIWL

SEQ ID NO: 3611 - protein, 104 aa, Cynodon dactylon
MADRLAKLSTEKAVVIFTTSQSSMSHTAASLFSDLGVCAVVHELDKDPWGRDMERELARRLGRSPPVPAVYIGGKLVGSTDRVMSLHLAGKLVPMLKGAGAMWL

SEQ ID NO: 3612 - protein, 103 aa, Secale cereale
MERVTKLSSEKAVVIFTMSNCPMSHSVTSLFSSLGVGAAVHELDKDPRGRDMERDLARRLGRTPPVPAVFIGGKLVGSTDRIMSLHLSGKLVVMLKAAGAMWL

SEQ ID NO: 3613 - protein, 112 aa, Panicum virgatum
RNQEETTATAERVSRLSTEKAVVIFTRSQCPMCHAMLSLFSELDVCAAVHELDKDPRGRDMERELARRLGRAPPVPAVFVGGNLVGSTDKVMSLHLGGELVPMLKAAGAIWL

SEQ ID NO: 3614 - protein, 104 aa, Brachypodium distachyon
MDRVTKLSSEKAVVIFTASEYPMCHTVTSLFSDLGVAVAEHELDKDPRGREMERDLARRLGGRSPPVPAVFIGGKLVGSTDKIMSLHLGGKLVPMLKAAGAIWL

SEQ ID NO: 3615 - protein, 104 aa, Panicum virgatum
MADRVATLSTEKAVVVFTASQCPMCHTVLSLFSDLSVCAAVHEVDQDLRGREVERELARRLGRTPPVPAVFIGGNLVGSTDRVMSLHLAGKLVPMLKAAGAIWV

SEQ ID NO: 3616 - protein, 103 aa, Pseudoroegneria spicata
MERVTKLSSEKAVVIFTMSNCPMSHSVTSLFSSLGVGAAVHELDKDPHGRDMERDLARRLGRTPPVPAVFIGGKLVGSTDRIMSLHLSGKLVVMLKAAGAMWL

SEQ ID NO: 3617 - protein, 814 aa, Setaria italica
MVKFSKQFEAQLVPEWKEAFVDYWQLKKDVKKLQAMAGDDVVVPAAVASPWLRQTPPTTAHWVMRLPFLQPHGHHREPAAIQACTSFICVHRKLVIDGSVDGAIAGEVYETGVADGAGFADAEAAKAFFHRLDQQLNKVNRFYERKEGEFMERGESLRRQLQILVELKAAITQQQQARRHGGSSKGSADMDDLSISCSIQLGDQSPRVIAEQEEDDQEKLTKDVTAKSTDEELGESGRLGRTNEEAARKLRTLSGRVVTCQGRNVRINIPVTTPSRTVTAIRELLFEDMLSQSKKTGTHGSDANEKLSINKRKLRQAEKMIRGALIELYKGLGYLRTYRSLNMMAFVKILKKFDKVTDKEVRQIYLKVVESSYFNSSDKAVRLMDDVEELFVRHFTEGDKRKAKMYLKPNQREESHSTTFFIGLFTGGFLALFIGYCIMARVTGMYTQQSNKVYMSTSYPVLSMFSLFFLHLFLYGCNIFMWRKTRINYTFIFEFAPTKELKYRDVFLICTSSMTIVVGVMFAHLTIIVKGNSSSAVQAIPGSLLLVFLSILVCPFNIIYRSSRYQFLRVIRNIILTPFYKVVMVDFFMADQLCSQVPVLRTLEYLACYYITGSYMTQDYGYCTRVKHFRDLAYAVSFLPYYWRAMQCARRWFDEGDINHIVNLGKYVSAMLAAGTKVAYENNNGAGWLSLVIIVSSIATIYQLYWDFVKDWGLLQFNSKNTWLRNDLILKQKYIYFLSMGLNLVLRLAWLQTVIHPNIGSLDSRVTLFFLAALEVIRRGHWNFYRLENEHLNNAGKFRAVKVVPLPFHEVEDN

SEQ ID NO: 3618 - protein, 862 aa, Sorghum bicolor
MVKFSKQFEGQLVPEWKEAFVDYWQLKKDVKKLQAAADGAVALASPLQPAVAPAHWVMRLPFFHPHGQPAAIQACTYQLSLALPNKVPFDAATPRLENKQACTYTYFAISISYYYISSYSKVHKKLAVDRSIDGAMAGEVYETAVADGAGFVDAEAAKAFFQRLDQQLNKVNRFYERKEGEFLERGESLRRQLQILVDLKAAITQQQQAQAQARRGADSKGSTDTDDHDPAVSCSIQLGGQSLREIAEKEQECEEKLNDDVTAKSTDEGPEDQLSVPQGLISESGRLGKPNEEVTSKLRTLSGRVVTCHGRNVRINIPVTTPSRTVTAIRELLFEDMLSQSKKIGTHGTDGNEKLSINKRKVHQAEKMIRGALVELYKGLGYLKTYRSLNMMAFVKILKKFDKVTAKEVQQIYLKVVESSYYNSSDKAVRLMDDVEELFLRHFTDGDKRKAMVYLKPNQREESHCTTFFIGLFTGGFIALFIGYCIMARIAGMYTQQSNKVYMSTSYPVLSMFSLFFLHLFLYGCNIFMWRKTRINYTFIFEFTPTKELKYRDVFLICTTSMTIVVGVMFAHLTIIVKGNSSSAVQAIPGSLLLVFLLILVCPFNFIYQSSRYQFLRVIRNIILTPFYKVVMVDFFMADQLCSQVPVLRSLEYLACYYITGSYMTQDYGYCTRVKHFRDLAYAVSFLPYYWRAMQCARRWFDEGDINHIVNLGKYVSAMLAAGTKVAYENNNSTGWLSLVIIVSSIATIYQLYWDFVKDWGLLQFNSKNTWLRNDLILKQKYIYFISMGLNLVLRLAWLQTVIHPNIGSLDSRVTLFFLAALEVIRRGHWNFYRLENEHLNNAGKFRAVKVVPLPFHEVEED

SEQ ID NO: 3619 - protein, 807 aa, Hordeum vulgare
MVKFSKQFEGQLVPEWKEAFVDYCLLKKDIKRVQAAEAAPPAAQCQPPVAASHWVMRLPFLNPHGHHKEHGAIQVHRKLASGGNDGAVAGEVYETEVLDAAGFDGVEAEAARAFFQRLDEQLNKVNRFYERKEGEFLERGECLRRQLQILIELKAAVVEARRRGGSTAAGSTDPEDPSVSCSILHGDQSLRGITEQEHVSQEKLAGDAAAKNTDEGEDHVPISEGLGDSGRTEKPRDEAANKLRTFSGRAVTCQGRSVRINIPVTTPSRTVFAIRELLFDDMLSQSRKTGGNGGDGGEKLSINKKKVHQAEKMIRGALVELYKGLGYLKTYRSLNMLAFVKILKKFDKVTAKEVQTIYLKVAESSYFNSSDKAIRLMDDVEELFVRHFTSGDKRKAMKYLKPNQKEESHATTFFIGLFTGGFVALFIGYCIMAHIAGMYTHQSNKVYMSTSYPVLSMFSLFFLHLFLYGCNIFMWRKTRINYAFIFEFAPTKELKYRDVFLICTTSMTIVVGVMFAHLTLIVKGYSSSTVQAIPGCLLLVFLLVLVCPFKILYRSSRYHFLSVIRNIILTPFYKVVMVDFFMADQLCSQVPVLRTLEYLACYYITSSYKTQDYGYCTRVKHFRDLAYAVSFLPYYWRAMQCARRWFDEGDINHIVNLGKYVSAMLAAGTKVAYENDNSAGWLSLVVIVSSIATIYQLYWDFVKDWGLLQFNSKNPWLRNDLILKQKYIYFISMGLNLLLRLAWLQTVIHPNIGSLDSRVTLFFLAALEVIRRGHWNFYRLENEHLNNAGKFRAVKVVPLPFHEVEEH

SEQ ID NO: 3620 - protein, 237 aa, Sorghum bicolor
MRKSSSCSGHVIGVPVTSKAYGIEEVSSRDPSSFRKGDAAGDHLAVSLTHPSPYASFGYKHSSKGQVIHWVSKLGRRAQGFREHVTLGPKLSETVKGKLSLGARILQAGGVERVFRQAFSAEKGERLVKALQCYIYTTGGPIAGMLFVSTKKVAFRSDRPITVTSPKGGTTARVTYKVVVPLRRIDKVRPSENVDRPEEKYIHVATVDGFEFWFMGFVSYQRSCKYMQQAVSELQLQ

SEQ ID NO: 3621 - protein, 233 aa, Panicum virgatum
MRKSSSTGAHVIGVPVTSKAFGIEAAASTRDPSSFRKGNGDHLAVSLTHPSPYASFGYNHSSKGQVVHWVSKLSRRAQGFREHVTLGPKLSETVKGKLSLGARILQAGGVERVFRQAFSADKGERLVKALQCYLYTTGGPIAGMLFVSTRKVAFRSDRPITVSSPRGDTARVTYKVVVPLRRIREVRPSENADRPEEKYIRVATVDGFEFWFMGFVSFQRSWRCMQQAVSELQ

SEQ ID NO: 3622 - protein, 234 aa, Panicum virgatum
MRKSSSGGCGHVIGVPVTSKAFGTEEAASTRDLSSFRKGDGDHLAVSLTHPSPYASFGYNHSSKGQVTHWVSKLSRRAQGFREHVTLGPKLSETVKGKLSLGARILQAGGVERVFRQAFSADKGERLVKALQCYLYTTGGPIAGMLFVSTRKVAFRSDRPITVSSPRGDTARVTYKVAVPLRRIREVRRSESADRPEEKYIRVATVDNFEFWFMGFVSYQRSWRCMEQAVSEPQ

SEQ ID NO: 3623 - protein, 233 aa, Panicum virgatum
  misc_feature (67)..(67): Xaa can be any naturally occurring amino acid
  misc_feature (75)..(75): Xaa can be any naturally occurring amino acid
MRKSSSTGAHVIGVPVTSKAFGIEEAASTRDPSSFRKGNGDHLAVSLTHPSPYASFGYNHSSKGQVXHWVSKLSXRAQGFREHVTLGPKLSETVKGKLSLGARILQAGGVERVFRQAFSADKGERLVKALQCYLYTTGGPIAGMLFVSTRKVAFRSDRPITVSSPRGDTARVTYKVAVPLRRIREVRRSESADRPEEKYIRVATVDGFEFWFMGFVSYQRSWRCMEQAVSEPQ

SEQ ID NO: 3624 - protein, 226 aa, Setaria italica
MRKSGSSGHVIGVPVTSKAYGIEEGTCRKSDGDHLAVSLTHPSPYASFDYKHSSKDHQVIRWVSKLSRRAQGFREHVTLGPKLSETVKGKLSLGARILQAGGVERVFRQAFSAEKGERLVKALQCYLYTTGGPIAGMLFVSTKKVAFRSDRPITVASPKGDTARVTYKVVIPLRRIGKVRPSENADRPEEKYIHVATVDGFEFWFMGFVSYQRSFKYMQQAVSELQ

SEQ ID NO: 3625 - protein, 222 aa, Pennisetum glaucum
GHVIGVPVTSKAYGIEEGSCRKSSDGDHLAVSLTHPSPYASFDYKHGSKGQAIHWVSKLSRRAQGFREHVTLGPKLSETVKGKLSLGARILQAGGVERVFRQAFSAEKGERLVKALQCYLYTTGGPIAGMLFVSTKKVAFRSDRPITVASPKGDTTARVTYKVVIPLRRIGKVRPSENADRPEEKYIHVATVDGFEFWFMGFVSYQRSFKYVQQAVSELQLQ

SEQ ID NO: 3626 - protein, 231 aa, Brachypodium distachyon
MKSSSGHVMGVPVTSKAYGIEEVSTRDQSFRKQVDGDHLAVSLTHPSPYTSFGYKHSSKGQVVHWVSKLGRRAQGFREHVTLGPKISETVKGKLSLGAKILQAGGIERVFRKAFSTEKGERLVKALQCYLYTTGGPIAGMLFVSTKKVAFRSDRPVAVTSPKGDVARVSYKVVVPLKRIGKVRPSENADRPEEKYIHVATVDGFEFWFMGFVSYQRSCKYMQQAISVSQQK

SEQ ID NO: 3627 - protein, 243 aa, Zea mays
MKKSSSGHVIGVPVISKAYGIEEEASRDPSSFSKGGDVDADHLAVSFTHPSPYASFGYKHSSSNHWVSKLSRRAQGFREHVTLGPKLSETVKGKLSLGARILQAGGVERVFRQAFSAADDDKQGERLLKALQCYIYTTGGPIAGMLFVSTRKVAFRSDRPVTVVTSSSSPAGVVRGTARVTYKVVVPLRRIRRVRPSENVHRPEEKYVHVATVDGFEFWFMGFVSFQRSCRCMQQAVSEVQTQ

SEQ ID NO: 3628 - protein, 156 aa, Sorghum bicolor
MESTALMTARLPLPTSGSRSKPLSPASFTRVARLLASVPFCSGSGGFVLLSRRSRDYAGVGPLVSAAAASGDTADAGSESILLSVQGMMCDGCAASVKRILESQPEVTSATVDYKEASAVVWTTDEAKGTQGWQKQYGEKLAKHLGTCGFESRVQE

SEQ ID NO: 3629 - protein, 157 aa, Saccharum officinarum
MANSLLLLVALVVAGCTALASATTYTVGDSQGWTTNFDYSTWASGKSFAVGDKLVFSYMSKAHSVTEVSKSGYDTCSGTNPLSDDESGSTVITLQTPGTHYFICNVPGHCANGMKLAVAVAATPSGTTPSAAGALQVPAMASVVAAAAGAAIKLALF

SEQ ID NO: 3630 - protein, 523 aa, Oryza sativa
MAYRNTVCTPQVIDLETEQGHSHIHSESFNRTGNDSSDQGAQHAVRGVGNATNIGLSDMRSYYDAGMNHPHQPVHNLPPNLGVDSGFVFPSSMYNPCMSTTSMNQYVSHTQSFGLPSNQVVLGSMDEGSRNENAGESARGFIKRKNAAVAGSYHCANGFASSSSSHASLNPTHRPWDPSFESNVLPNTASYNPSEYHSQTSWPSMEGSSIPSNGFNLMGAHPESAQHGNYAFPTSHISQCFQPTSNTWISQSANGIADGIPQWEYVNGMNNAPGRFSRSGMTETVNGSFREYQNGPSTLCRGPLPYFHQHAGMHAHNLLDHTQVQAPYQQCHNNPVLHGVNHSGNRFHLGPRIPVLFSNSERTFGPPHHPLLANPVNHRNIRILPPEHATIMDFSRLYEVSNVVDEHRDMRLDIDSMTYEELLALEEQIGDVNTGLAKSYIVEKLKTSLFVPGSSCMSNKSSESSMENDACIICQEEYQVKECIGTLDCGHRYHEDCIKQWLMVKNLCPICKTTALSTGRRSG

SEQ ID NO: 3631 - protein, 218 aa, Hordeum vulgare
MAVAYRAEEEYDYLFKVVLIGDSGVGKSNLLSRFARDEFSLDTRSTIGVEFATKTVRVDGKLVKAQIWDTAGQERYRAITSAYYRGAVGALVVYDVTRHITFENAERWLTELRDHTDANIVVMLVGNKADLRHLRAVSPEEARAFAERHRTFSMETSALEATNVEDAFTEVLGEIYRVVSKKALDIGDDPAAPPRGKTIDVGAKDDVTPVNSGGCCSA

SEQ ID NO: 3632 - protein, 218 aa, Leymus cinereus x Leymus triticoides
MAVAYRAEEEYDYLFKVVLIGDSGVGKSNLLSRFARDEFSLDTRSTIGVEFATKTVRVDGKLVKAQIWDTAGQERYRAITSAYYRGAVGALVVYDVTRHITFENAERWLTELRDHTDANIVVMLVGNKADLRHLRAVSPEEARAFAERHRTFSMETSALEATNVEDAFTEVLGEIYRVVSKNALDIGDDPAAPPRGKTIDVGAKDDVTPVNTGGCCSA

SEQ ID NO: 3633 - protein, 220 aa, Zea mays
MASGYRAEEEYDYLFKVVLIGDSGVGKSNLLSRFARDEFSLETRSTIGVEFATKTVQVDDKLVKAQIWDTAGQERYRAITSAYYRGAVGALVVYDVSRRTTFDNAERWLRELRDHTDANIVVMLVGNKADLRHLRAVSPEDAAAFAERHGTFSMETSALDATNVERAFAEVLRQIYHVVSRNALDIGDDPAAPPRGKTIDVSAAKDEVSPVNAGGCCSSA

SEQ ID NO: 3634 - protein, 219 aa, Setaria italica
MAAGYRAEEEYDYLFKVVLIGDSGVGKSNLLSRFARDEFSLETRSTIGVEFATKTVQVDGKLVKAQIWDTAGQERYRAITSAYYRGAVGALVVYDVTRRVTFENAERWLRELRDHTDANIVVMLVGNKADLRHLRAVSPEDAAAFAERHGTFSMETSALDATNVERAFAEVLRQIYHVVSRNALDIGEDPAAPPRGKTIDVGAAKDEVSPVNTGGCCSA

SEQ ID NO: 3635 - protein, 218 aa, Pseudoroegneria spicata
MAVAYRAEEEYDYLFKVVLIGDSGVGKSNLLSRFARDEFSLDTRSTIGVEFATKTVRVDGKLVKAQIWDTAGQERYRAITSAYYRGAVGALVVYDVTRHITFENAERWLTELRDHTDANIVVMLVGNKADLRHLTAVSPEEARAFAERHRTFSMETSALEATNVEDAFTEVLGEIYRVVSKKALDIGDDPAAPPRGKTIDVGAKDDVTPVNTGGCCSA

SEQ ID NO: 3636 - protein, 218 aa, Secale cereale
MAVAYRAEEEYDYLFKVVLIGDSGVGKSNLLSRFARDEFSLDTRSTIGVEFATKTVRVDGKLVKAQIWDTAGQERYRAITSAYYRGAVGALVVYDVTRHITFENAERWLTELRDHTDANIVVMLVGNKADLRHLRAVSPEEARAFAERHRTFSMETSALEATNVEDAFTDVLGEIYRVVSKKALDIGDDPAAPPRGKTIDVGAKDDVTPVNTGGCCSA

SEQ ID NO: 3637 - protein, 219 aa, Saccharum officinarum
MAAGYRAEEEYDYLFKVVLIGDSGVGKSNLLSRFARDEFSLETRSTIGVEFATKTVQVDDKLVKAQIWDTAGQERYRAITSAYYRGAVGALVVYDVTRRITFDNAERWLRELRDHTDANIVVMLVGNKADLRHLRAVTPEDAAAFAERHGTFSMETSALDATNVDRAFAEVLRQIYHVVSRNALDIGHDPAAPPRGKTIDVGAAKDEVSPVNAGGCCSA

SEQ ID NO: 3638 - protein, 218 aa, Triticum aestivum
MAVAYRAEEEYDYLFKVVLIGDSGVGKSNLLSRFARDEFSLDTRSTIGVEFATKTVRVDGKLVKAQIWDTAGQERYRAITSAYYRGAVGALVVYDVTRHITFENAERWLTELRDHTDANIVVMLVGNKADLRHLRAVSPEEARAFAERHRTFSMETSALEATNVEDAFTEVLGEIYRVVSKKALDIGDDPAAPPRGKTIDVGGKDDVTPVNTGGCCSA

SEQ ID NO: 3639 - protein, 219 aa, Panicum virgatum
MASGYRAEEEYDYLFKVVLIGDSGVGKSNLLSRFARDEFSLETRSTIGVEFATKTVQVDDKLVKAQIWDTAGQERYRAITSAYYRGAVGALVVYDVTRRVTFENAERWLRELRDHTDANIVVMLVGNKADLRHLRAVSPEDAAAFAERHGTFSMETSALDATNVERAFAEVLRQIYHVVSRNALDIGEDPAAPPRGKTIDVGAAKDEVSPVDAGGCCSA

SEQ ID NO: 3640 - protein, 219 aa, Sorghum bicolor
MASGYRAEEEYDYLFKVVLIGDSGVGKSNLLSRFARDEFSLETRSTIGVEFATKTVQVDDKLVKAQIWDTAGQERYRAITSAYYRGAVGALVVYDVTRRITFDNAERWLRELRDHTDANIVVMLVGNKADLRHLRAVTPEDAAAFAERHGTFSMETSALDATNVDRAFAEVLRQIYHVVSRNALDIGEDPAAPPRGKTIDVGAAKDEVSPVNTGGCCSA

SEQ ID NO: 3641 - protein, 219 aa, Panicum virgatum
MASGYRAEEEYDYLFKVVLIGDSGVGKSNLLSRFARDEFSLETRSTIGVEFATKTVQVDEKLVKAQMWDTAGQERYRAITSAYYRGAVGALVVYDVTRRITFENAERWLRELRDHTDANIVVMLVGNKADLRHLRAVSPEDAAAFAERHGTFSMETSALDATNVERAFAEVLRQIYHVVSRNALDIGEDPAVPPRGKTIDVGAAKDEVSPVNAGGCCSA

SEQ ID NO: 3642 - protein, 219 aa, Panicum virgatum
  misc_feature (162)..(162): Xaa can be any naturally occurring amino acid
MASGYRAEEEYDYLFKVVLIGDSGVGKSNLLSRFARDEFSLETRSTIGVEFATKTVQVDDKLVKAQIWDTAGQERYRAITSAYYRGAVGALVVYDVTRRVTFENAERWLRELRDHTDANIVVMLVGNKADLRHLRAVSPEDAAAFAERHGTFSMETSALDAXNVERAFAEVLRQIYHVVSRNALDIGEDPAAPPRGKTIDVGAAKDEVSPVDAGGCCSA

SEQ ID NO: 3643 - protein, 219 aa, Brachypodium distachyon
MAVAYRAEEEYDYLFKVVLIGDSGVGKSNLLSRFARDEFSLDTRSTIGVEFATKTVQVDGKLVKAQIWDTAGQERYRAITSAYYRGAVGALVVYDVTRHITFENAERWLAELRDHTDANIVVMLVGNKADLRHLRAVPPEEARAFAERHRTFSMETSALESTNVEGAFTEVLGEIYRVVSKKALDIGDDPAAPPRGKTINVGAAKDEVSPVNTGGCCSA

SEQ ID NO: 3644 - protein, 95 aa, Avena sativa
MAVAYRAEEEYDYLFKVVLIGDSGVGKSNLLSRFARDEFSLDTRSTSASSSPPRPSASTESWSRRRSGTPPARKGTEPSPARTTAGQLARWWCTT

SEQ ID NO: 3645 - protein, 200 aa, Pennisetum glaucum
MAGGYRTEEEYDYLFKVVLIGDSGVGKSNLLSRFARDEFSLETRSTIGVEFATKTVQVDDKLVKAQMWDTAGQERYRAITSAYYRGAVGALVVYDVTRRVTFENAERWLRELRDHTDANIVVMLVGNKADLRHLRAVSPEDAAAFAERHGTFSMETSALDATNVERAFAEVLRQIYHVVSRNALDIGEDPAAPPRGKTID

SEQ ID NO: 3646 - protein, 216 aa, Panicum virgatum
MAYRAEDDYDYLFKVVLIGDSGVGKSNLLSRFTRNEFSLESKSTIGVEFATRSIRVDDKVVKAQIWDTAGQERYRAITSAYYRGAVGALVVYDVTRHVTFENVERWLKELRDHTDANIVIMLVGNKADLRHLRAVSVEDAKGFAERESTFFMETSALESMNVESAFTEVLTQIYRVVSKKALDIGDDPAAPPRGQTINVGGKDDVSAVKKSGCCSS

SEQ ID NO: 3647 - protein, 103 aa, Zea mays
MSASSSMTKKASSFVVAASMSAVEALKDQAGLCRWDYALRSLYNRAAAANKVVAGRAVPLSLSSSQTAGGSGSAAAAGRAARPRRSEEEKMHKAYHLVCWGPN

SEQ ID NO: 3648 - protein, 360 aa, Brachypodium distachyon
MLDTKHTLQVLPWILLFAQQAAASGCDCTAATDGADKQGAMKLKLVAIASILTAGAAGVLVPVLGRSLAALRPDGDIFFAVKAFAAGVILATGMVHILPAAFDGLTSPCLHKGGGGRNGFPFAGLVAMSAAMATMVIDSLAAGYYRRSNFSKARPIENVDIPGQAGEEEGRTEHVHHATHGHSHGEAVVVSSPEEASIADTIRHRVVSQVLELGILVHSVIIGVSLGASVRPSTIRPLVGALSFHQFFEGIGLGGCIVQANFKVRATIIMATFFSLTAPVGIVLGIAISSSYNVHSSTAFIIEGVFNSASAGILIYMSLVDLLATDFNNPKLQTNTKLQLMTYLALFMGAGMMSMLAIWA

SEQ ID NO: 3649 - protein, 364 aa, Avena sativa
MSTTKHTLQVLPWLLLFAQQAAASSGCDCTTATDGADKQGAEKLKLVAIASILTAGAAGVLVPVLGRSMAALRPDGDIFFAVKAFAAGVILATGMVHILPAAFDSLTSPCLHKGGGGRNSFPFAGLVAMCAAMATMVIDSLAAGYYRRSHVSKAQPIDSIYVPEHVGDEEGRTGHAHGHVSATHGHSHGEAVVISSPEEASIADTIRHRVVSQVLELGILVHSVIIGVSLGASVRPSTIRPLVGALSFHQFFEGIGLGGCIVQANFKVRATIIMATFFSLTAPVGIVLGIAVSSSYNVHSPTAFIIEGVFNSASAGILIYMSLVDLLATDFNNPKLQTNTKLQLMTYLALFLGAGMMSMLAIWA

SEQ ID NO: 3650 - protein, 362 aa, Hordeum vulgare
MWATKHTLQALLPWLLLFVQQAAASGGCECTTATDGADKQGAMKLKLVAIASILAAGAAGVLVPVLGRSMAALRPDGDIFFAVKAFAAGVILATGMVHILPAAFDGLTSPCIHKGGGDRNGFPFAGLVAMSAAMATMVIDSLAAGYYRRSHFSKARPLDNIDIPGHTGDEEGRADHPHVHTHGHSHGEAIAVSSPEEAAIADTIRHRVVSQVLELGILVHSVIIGVSLGASVRPSTIKPLVGALSFHQFFEGIGLGGCIVQANFKVRATIIMATFFSLTAPVGIVLGIAVSSSYNVHSSTAFIIEGVFNSASAGILIYMSLVDLLATDFNNPKLQTNTKLQLMTYLALFLGAGMMSMLAIWA

SEQ ID NO: 3651 - protein, 362 aa, Pseudoroegneria spicata
  misc_feature (330)..(330): Xaa can be any naturally occurring amino acid
MGATNHTLQALLPWLLLFVQQAAASGGCECTTATDGADKQGATKLKLVAIASILTAGAAGVLVPVLGRSMAALRPDGDIFFAVKAFAAGVILATGMVHILPAAFDGLTSPCIHKGGGDRNGFPFAGLVAMSAAMATMVIDSLAAGYYRRSHFSKARPLDNIDMPEHAGDEEGRANHPHVHAHGHSHGEAIVVSSPEEAAIADTIRHRVVSQVLELGILVHSVIIGVSLGASVRPSTIKPLVGALSFHQFFEGIGLGGCIVQANFKVRATIIMATFFSLTAPMGIVLGIAISSSYNVHSPTAFIIEGVFNSASAGILIYMSLVDLLATDFXNPKLQTNTKLQLMTYLALFLGAGMMSMLAIWA

SEQ ID NO: 3652 - protein, 360 aa, Triticum aestivum
MGATNHTLQALLPWLLLFVHQAAAASGGCECTTATDGADKQGATKLKLVAIASILTAGAAGVLVPVLGRSMAALRPDGDIFFAVKAFAAGVILATGMVHILPAAFDGLTSPCIHKGGGDRNGFPFAGLVAMSAAMATMVIDSLAAGYYRRSHFSKARPLDNIDIPGDEEGRADHPHVHAHGHSHGDAIVVSSPEEAAIADTIRHRVVSQVLELGILVHSVIIGVSLGASVRPSTIKPLVGALSFHQFFEGIGLGGCIVQANFKVRATIIMATFFSLTAPVGIVLGIAISSSYNVHSSTAFIIEGVFNSASAGILIYMSLVDLLATDFNNPKLQTNTKLQLMTYLALFLGAGMMSMLAIWA

SEQ ID NO: 3653 - protein, 1388 aa, Oryza sativa
MGDKMITRKLSFNQKDMDVTEIDLQDYKDVDSIAFYQVPTNVGSGMSMESERLVRVHACTDHNGVSFLHKLLHRLLEHKEMYSNVVNLLFHGIEWQTEGVQLLCSFLGPGSSVKQVEFQKNVFGTKSSAALVPLSEMIQRNNTIKAIVFSECRIGASGVKLLASALAYNRSVEEVQLLDDSIGAKGAEEFSKMIEVNCVLKLLVILDNSSIAAAPIFSAVLARSRRVEVHVWGHCRDTRGGMNSCKIAEFQAGTGSLRIYNNINSTGLQRIACAMAWNTTVTTLDMSGVPLKSKWTKELRGVLERNRMLKTVKLTKCCLRDKAVVYIAAGLFKNSYLESLSLDGNRFGGVGLEHLLCPLSTFSPLQRQANLTLKVLSFGGRQTNIGRYGITAILQMLETNQSLLQLAICDDVSLRPNDVVRIFTSLERNTTLRNLSLKGCRGVEGELVLQTIMGMLQVNPWIEEIDLHETPLHVAGKTREIYEKLGQNGSSVVPNDLLDLPLSAPTCCQVFLCGQELSGKSTLCSSIKHCMNSMKLPRMDEIRTSKTPIEQMSHTNEYGMNIIFDGNTKLTMCNIGGPEESIPLHDFMFVVHGGPRIFMIVSSLIGKPADKYPKSIDVIEQELIYWLKFVASNSRRRVSHSFIPCVTIVLTHYDKVSHLAEGLQLIVAAVQRLREDFCSYAEIYPTVFVVDSRSQVSVSKLTHHLRNTTKTVLQQAPQVYEVCNDLIRYLHNWRLKNDKSVVKWSEFCEICQLSIPVLRLRSRHDNAEKLDTRRHAVAKSLHDLGEIIFFEELGVLIMNCEWFCQDILSQLGALKSIKIENSGFVRKQDLEKILQEKLCNQIQRSNWRAGASLQSGDIINMLLKLELCYEQDPGNPNTLLLVPAMLEESKEGIQRWQLTMPECRYAGRHMECEDTHMFLTNDFFPRLQVRLHNKIMCPGNQQGAVYNLEKNLIYTVIDGVHVRVELGMKLGSSIDVLACSTRNVTDMVRLLHKSVITTILNMSPSMTFKESIIRPDCVKYLIPQRFRTTQLLPVKKIKHILLSLPAESFYDYQHTWSAVENNKRVILMSGLDHARDLLSDDDFHDVLHRRYYDLQHLATELAVTPDNLQQSETIAESDAVDPSILGIAKGVEMVLQRLKRIEQGIQDLKEEIARLRYYEYHLVTELHRKMDYVMNYSIQLEDRKVPQLFYLVSLDSRSKKLVTRILPGMRSLRVHMLCEFRQEMHVLEDQVGCDLIQVDNRAVQSLLPYMSKFMKLLTFALKIGAHFIVGMGEMIPDLSREVVHLLDSSVMYGATTSALSLGALGAAAMYGKARNNGSQSGTNDMEDDMKTARQWLVDFLKGQGILTGMDIAQRFGLWRVRYRDDGHIAWICRKHIVARADEIFELPL

SEQ ID NO: 3654 - protein, 748 aa, Zea mays
MASRKSPVAAEERAGTGTGEGKGERCAVEEVALVVPETDDPSMPVMTFRAWALGLGSCVVLIFLNTFFTYRTQPLTISGILAQILVLPAGRFLAAVLPDREVRILGGRLGSFNLNPGPFNVKEHVIITIFANCGVSYGGGDAYSIGAITVMKAYYKQTLSFACALLIVLTTQILGYGWAGLLRRYLVDPAEMWWPSNLAQVSLFRALHEKEEEGGKSRGPSRMRFFLIVFFASFAYYALPGYLLPILTFFSWACWAWPHSITAQQVGSGYHGLGVGAFTLDWAGISAYHGSPLVAPWASIANTAVGFVMFIYVIVPLCYWQFNTFDARRFPIFSNQLFTASGQKYDTTKVLTKDFDLNVAAYDSYGKLYLSPLFAISIGSGFLRFTATIVHVLLFHGSDMWKQSKSAMNAVKLDVHAKLMQRYRQVPQWWFLMLLLGSVVVSLLMSFVWKEEMQLPWWGMLFAFALAFVVTLPIGVIQATTNQQPGYDIIAQFMIGYALPGKPIANLLFKIYGRISTVHALSFLADLKLGHYMKIPPRCMYTAQLVGTVVAGVVNLAVAWWMLDNIENICDVEALHPDSPWTCPKYRVTFDASVIWGLIGPGRLFGQHGLYRNLVWLFLVGAVLPVPVWLLSRAFPEKKWIALINVPVISYGFAGMPPATPTNIATWLVTGTIFNYFVFRYRKGWWQKYNYVLSAALDAGTAFMGVLIFFALQNAHHELKWWGTEVDHCPLASCPTAPGIAVKGCPVF

SEQ ID NO: 3655 - protein, 747 aa, Sorghum bicolor
MAPSRKSPVVAEERAGMEEGKGERCAVEEVALVVPETDDPSLPVMTFRAWTLGLGSCVVLIFLNTFFTYRTQPLTISGILAQILVLPAGRFMAAVLPNREVRLLGGRLGSFNLNPGPFNVKEHVIITIFANCGVSYGGGDAYSIGAITVMKAYYKQTLSFACALLIVLTTQILGYGWAGMLRRYLVDPAEMWWPSNLAQVSLFRALHEKEEEGGKSRGPSRMRFFLIVFFASFAYYALPGYLLPILTFFSWACWVWPHSITAQQVGSGYHGLGVGAFTLDWAGISAYHGSPLVAPWASIANTAVGFVMFIYVIVPLCYWQFNTFDARRFPIFSNQLFTASGQKYDTTKVLTKDFDLNVAAYDSYGKLYLSPLFAISIGSGFLRFTATIVHVLLFHGSDMWKQSKSAMNAVKMDVHAKLMQRYRQVPQWWFLMLLLGSVVVSLLMSFVWKEEVQLPWWGMLFAFALAFVVTLPIGVIQATTNQQPGYDIIAQFMIGYALPGKPIANLLFKIYGRISTVHALSFLADLKLGHYMKIPPRCMYTAQLIGTVVAGVVNLAVAWWMLDNIDNICDVEALHPDSPWTCPKYRVTFDASVIWGLIGPGRLFGRHGLYRNLVWLFLVGAVLPVPVWLLSRAFPEKKWIALINVPVISYGFAGMPPATPTNIATWLVTGTIFNFFVFRYRKAWWQKYNYVLSAALDAGTAFMGVLIFFALQNAHHDLKWWGTEVDHCPLASCPTAPGIAVKGCPVF

SEQ ID NO: 3656 - protein, 746 aa, Panicum virgatum
MASRKPAPVAAEQAGKQGEEGERCPVEEVALVVPETDDPSLPVMTFRAWTLGLGSCVVLIFLNTFFTYRTQPLTISGILAQILVLPAGRFMAAVLPDREVRVLGGRFGSFNLNPGPFNVKEHVIITIFANCGVSYGGGDAYSIGAITVMKAYYKQTLSFVLALLIVLTTQILGYGWAGMLRRYLVDPAEMWWPSNLAQVSLFRALHEKEEGDDKSRGPSRMRFFLIVFFASFAYYALPGYLLPILTFFSWACWVWPLSITAQQVGSGYHGLGVGAFTLDWAGISAYHGSPLVAPWASIANTAVGFVMFIYVIVPLCYWQFNTFDARRFPIFSNQLFTAAGQKYDTTKVLTKDLDLNVAAYDSYGKLYLSPLFAISIGSGFLRFTATIVHVLLFHGSDMWKQSRSAMNAVKLDVHAKLMQRYKQVPQWWFLVLLLGSVVVSLLMSLVWKEEVQLPWWGMLFAFALAFVVTLPIGVIQATTNQQPGYDIIAQFMIGYVLPGKPIANLLFKIYGRISTVHALSFLADLKLGHYMKIPPRCMYTAQLVGTVVAGVVNLAVAWWMLDNIENICDVEALHPDSPWTCPKYRVTFDASVIWGLIGPGRLFGRHGLYRNLVWLFLAGAVLPVPVWLLSRAFPEKKWIALINIPVISYGFAGMPPATPTNIATWLVTGTIFNYFVFRYRKGWWQKYNYVLSAALDAGTAFMGVLIFFALQNAHHDLKWWGTEVDHCPLASCPTAPGIAVKGCPVF

SEQ ID NO: 3657 - protein, 752 aa, Triticum aestivum
MPSAKPPAPAADAAGGKAAAQGEGEGERYPVEEVALVVPETDDPATPVMTFRAWTLGLASCVVLIFLNTFFTYRTQPLTISGILAQILVLPVGRFMASVLPDREVRLLGGRLGSFNLNPGPFNIKEHVIITIFANCGVSYGGGDAYSIGAITVMKAYYKQSLSFLCALLIVLSTQILGYGWAGMLRRFLVDPAEMWWPSNLAQVSLFRALHETKEGGKPSTGPSRMRFFLIFFFASFAYYALPGYLLPILTFFSWACWVWPRSITAQQVGSGYHGLGVGAFTLDWAGISAYHGSPLVAPWASIANTAVGFVMFIYVIVPLCYWRFNTFDARRFPIFSNQLFTATGQKYDTTKVLTSDFDLNVAAYDSYGKLYLSPLFAISIGSGFLRFSATIVHVLLFHGADMWRQSRRAIGAAAKLDVHARLMQRYKQVPQWWFLVLLAGSIAVSLLMCFVWKEQVQLPWWGMLFAFALAFVVTLPIGVIQATTNQQPGYDIIAQFMIGYALPGKPIANLLFKIYGRISTVHALSFLADLKLGHYMKIPPRCMYTAQLVGTVVAGVVNLAVAWWMLDSIDNICDVEALHPDSPWTCPKYRVTFDASVIWGLIGPGRLFGQHGLYRNLVWLFVVGAVLPVPVWLLSRAFPEKKWIALVNVPVISYGFAGMPPATPTNIASWLVTGTVFNFFVFRYRKGWWQKYNYVLSAALDAGTAFMGVLIFFALQNAHHDLKWWGTEVDHCPLATCPTAPGIVVKGCPVF

SEQ ID NO: 3658 - protein, 166 aa, Secale cereale
GEGERYPVEEVALVVPETDDPATPVMTFRAWTLGLTSCVVLIFLNTFFTYRTQPLTISGILAQILVLPVGRFMASVLPDREVRLLGGRLGSFNLNPGPSTSRSTSSSPSSPTAASPTAAATPTPSRHHRHEGLLQAVAQLPLRPPHRPLHADSGLWLGWHAEEVPG

SEQ ID NO: 3659 - protein, 718 aa, Panicum virgatum
VALVVPETDDPSLPVMTFRAWTLGLGSCVVLIFLNTFFTYRTQPLTISGILAQILVLPAGRFMAAVLPDREVRVLGGRLGSFNLNPGPFNVKEHVIITIFANCGVSYGGGDAYSIGAITVMKAYYKQTLSFVLALLIVLTTQILGYGWAGMLRRYLVDPAEMWWPSNLAQVSLFRALHEKEEGDDKSRGPSRMRFFLIVFFASFAYYALPGYLLPILTFFSWACWVWPHSITAQQVGSGYHGLGVGAFTLDWAGISAYHGSPLVAPWASIANTAVGFVMFIYVIVPLCYWQFNTFDARRFPIFSNQLFTAAGQKYDTTKVLTKDLDLNVAAYDSYGKLYLSPLFAISIGSRFLRFTATIVHVLLFHGSDMWKQSRSAMNAVKLDVHAKLMQRYKQVPQWWFLVLLLGSVVVSLLMSLVWKEEVQLPWWGMLFAFALAFVVTLPIGVIQATTNQQPGYDIIAQFMIGYVLPGKPIANLLFKIYGRISTVHALSFLADLKLGHYMKIPPRCMYTAQLVGTVVAGVVNLAVAWWMLDNIENICDVEALHPDSPWTCPKYRVTFDASVIWGLIGPGRLFGRHGLYRNLVWLFLAGAVLPVPVWLLSRAFPEKKWIALINIPVISYGFAGMPPATPTNIATWLVTGTIFNYFVFRYRKGWWQKYNYVLSAALDAGTAFMGVLIFFALQNAHHDLKWWGTEVDHCPLASCPTAPGIAVKGCPVF

SEQ ID NO: 3660 - protein, 702 aa, Setaria italica
MTFRAWTLGLASCVVLIFLNTFFTYRTQPLTISGILAQILVLPAGRFMAAVLPDREVRLLGGRLGSFNLNPGPFNVKEHVIITIFANCGVSYGGGDAYSIGAITVMKAYYKQTLSFVLALLIVLTTQILGYGWAGMLRRYLVDPAEMWWPSNLAQVSLFRALHEKEDGEKSRGPSRMRFFLIVFFASFAYYALPGYLLPILTFFSWACWVWPHSITAQQVGSGYHGLGIGAFTLDWAGISAYHGSPLVAPWASIANTAVGFVMFIYIIVPLCYWQFNTFDARRFPIFSNQLFTAAGQKYDTTKVLTKDFDLNVAAYDSYGKLYLSPLFAISIGSGFLRFTSTIVHVLLFHGSDMWKQSRSAMNAVKLDVHAKLMQRYKQVPQWWFLVLLLGSVVVSLLMAFVWKEEVQLPWWGMLFAFALAFVVTLPIGVIQATTNQQPGYDIIAQFMIGYALPGKPIANLLFKIYGRISTVHALSFLADLKLGHYMKIPPRCMYTAQLVGTVVAGVVNLAVAWWMLDNIENICDVEALHPDSPWTCPKYRVTFDASVIWGLIGPGRLFGRHGLYRNLVWLFVVGAVLPVPVWLLSRAFPEKKWIALINIPVISYGFAGMPPATPTNIATWLVTGTIFNYFVFRYRKGWWQKYNYVLSAALDAGTAFMGVLIFFALQNAHHELKWWGTEVDHCPLASCPTAPGIVVKGCPVF

SEQ ID NO: 3661 - protein, 748 aa, Musa acuminata
MASNKSSVPQESAPEVAAAAGEEEGEEKEYRPVEEVALVVPETDDPSLPVMTFRAWFIGLASCTILIFLNTFFTYRTQPLTISAILAQITALPVGRFMASVLPNREIRVFRNWGFNLNPGPFNIKEHVIITIFANCGVSIGGGDAYSIGAITVMKAYYKQSLSFLCGLIIVLTTQILGYGWAGMLRRYLVDPAEMWWPSNLAQVSLFRALHEKDSRSKGLTRMQFFVLFFVASFAYYTLPGYLLPILTFFSWICWSWPRSITAQQIGSAYHGLGVGAFTLDWAGISAYHGSPLVTPWFSILNTAVGFIMFIYIIVPLCYWKFNTFDARKFPIFSNQLFTTRGQKYDTTKILTPNYDLNVAAYESYGKLYLSPLFALSIGSGFARFSATIVHVLLFHGSDIWRQSKSAMNSAKVDIHAKLMKKYKQVPHWWFLILLAASVILSLMMSFVWKEEVQLPWWGMIFAFGLACLVTLPIGVIQATTNQQPGYDIIAQFIIGYVLPGKPIANLLFKIYGRISTIHALSFLADLKLGHYMKIPPRCMYTAQLVGTVVSGVVNLAVAWWMLGSIENICDVDALHPESPWTCPKYRVTFDASVIWGLVGPGRLFGHGGLYRNLVWLFLVGAALPVPVWALSKIFPEKKWIPLINIPVISYGFAGMPPATPTNIASWLITGTIFNYFVFRYRKGWWQKYNYVLSAALDAGTAFMGVLLFFALQNANHNLRWWGTELDHCPLASCPTEPGISVKGCPVF

SEQ ID NO: 3662 - protein, 740 aa, Musa acuminata
MASKGENKGGSSTAEEGEEVERCPVEEVALVVPETDDPSLPVMTFRAWFLGLTSCSLLIFLNTFFTYRTQPLTISAILMQIAVLPAGRFMASVLPDREVKVFRNWGFHLNPGPFNIKEHVIITIFANCGVSIGGGDAYSIGAITVMKAYYKQSLSFLCALIIVLTTQILGYGWAGMMRRYLVDPAEMWWPSNLAQVSLFRALHEKDSRSKGPSRMQFFLVFFVASFAYYTLPGYLLPILTFFSWVCWTWPRSITAQQIGSAYHGLGVGAFTLDWAGISAYHGSPLVTPWFSILNVAVGFLMFIYIIVPLCYWKFNTFDARKFPIFSNQLFTTTGHKYDTTKILTPEFELNVAAYESYGKLYLSPLFALSIGSGFARFTATIIHVLLFHGSDIWRQSKSAMKSVKLDIHAKLMRRYNQVPQWWFLVLLVGSIALSLMMSFIWKEEVQLPWWGMIFAFGLAWIVTLPIGVIQATTNQQPGYDIIAQFMIGYVLPGKPIANLLFKIYGRISTIHALSFLSDLKLGHYMKIPPRCMYTAQLVGTVVAGVVNLGVAWWMLESIENICDVESLHPDSPWTCPKYRVTFDASVIWGLIGPGRLFGHGGLYRNLVWLFLVGAVLPVPVWVLSKIFPEKKWIPLINIPVISYGFAGMPPATPTNIASWLITGTIFNYFVFRYRKGWWQKYNYVLSAALDAGTAFMGVLLFFALQNQDHNLKWWGTELDHCPLASCPTAPGISVEGCPVF

SEQ ID NO: 3663 - protein, 662 aa, Musa acuminata
MQIAVLPIGRLMASVLPDREVNLLPGWGFNLNPGPFNIKEHVIITIFASCGVSYGGGDAYSIGAITVMKAYYKQNLSFLCALLIVLSTQILGYGWAGMMRRYLVEPPEMWWPSNLAQVSLFRALHEKDSRSQGLSRMRFFLIFFVASFAYYTLPGYLLPILTFFSWMCWAWPRSITAQQIGSAYHGLGVGAFTLDWAGISAYHGSPLVTPWFSILNVAIGFIMFIYIIVPVCYWKFNTFDARKFPVFSNQLFTATGHKYDTTKILTPDFDLNVAAYDSYGKLYLSPLFALSIGSGFARFTATISHVLLFHGSDIWRQSKSAMNSLKLDIHGKLMRRYKQVPQWWFVVLLAGSIVLSLMLSFVWKEEVQLPWWGMIFAFGLAWLVTLPIGVIQATTNQQPGYDIIAEFMIGYVLPGKPIANLLFKIYGRISTIHALSFLADLKLGHYMKIPPRCMYTAQLAGTVVAGVLNLSVAWWMLENIENICDVDSLHPDSPWTCPKYRVTFDASVIWGLIAPGRLFGHGGLYRNLVWLFLVGAVLPVPVWVLSKVFPEKKWISLINVPVITYGFAGMPPATPTNIASWLITGTIFNYFVFRYRKVWWQRYNYVLSAALDAGTAFMGVLLFFALQNQHHNLHWWGSELDHCPLASCPTAPGISVKGCPVF

SEQ ID NO: 3664 - protein, 745 aa, Quercus alba
MASKNQSEYQTDTEKSNGGGANGASEERCPIEEVALVVPETDDPSIPVMTFRAWFLGITSCTLLIFLNTFFTYRTQPLAISAILMQIAVLPIGKFMAATLPRNEYSLFGWRFSLNPGPFNMKEHVIITIFANCGISYGGGDAYSIGAITVMRAYYKQGVSFLCSLLIVLSTQILGYGWAGMLRRYLVDPVEMWWPANLAQVSLFRALHEREPKNSGMTRMRFFYIAMAASFAYYALPGYLFPILTFFSWVCWAWPHSITAQQIGSGYHGLGVGAFTIDWAGISAYHGSPLVAPFSSILNVGVGFIMFIYIIVPLCYWKFDTFDARKFPIFSNQLFTHSGTKYDTTKILTPQYDLNIAAYDSYGKLYLSPLFALSIGSGFARFTATLTHVALFHGSDIWKQSRSAIKNAKLDIHAKLMKNYKQVPEWWFLVLLIGSIVVSLLLCFVWKEDVQLPWWGMLFAFALAFIVTLPIGIIQATTNQQPGYDIIAQFMIGYVLPGKPIANLLFKIYGRISTVHALSFLSDLKLGHYMKIPPRCMYTAQLVGTLVSGVVNLAVAWWMLESIENICDVEALHPDSPWTCPKFRVTFDASVIWGLIGPKRLFGPGGMYRNLVWLYLVGAFLPVPVWVLSKIYPDKKWIPLINIPVISYGFAGMPPATPTNIASWLITGTIFNYFVFKYHKGWWQKYNYVLSAALDAGTAFMGVLLFFALQNEGKNLKWWGTKLDHCPLASCPTAPGIVVEGCPVF

SEQ ID NO: 3665 - protein, 737 aa, Arabidopsis lyrata
MDAEKASDRNNVHLSSDHERCPVEEVALVVPETDDPSIPVMTFRAWFLGLTSCVLLIFLNTFFTYRTQPLTISAILMQIAVLPIGKFMARTLPTTSHNLLGWNFSLNPGPFNIKEHVIITIFANCGVSYGGGDAYSIGAITVMKAYYKQSLSFICGLFIVLTTQILGYGWAGILRRYLVDPVDMWWPSNLAQVSLFRALHEKENKSKGLTRMQFFLVALGASFLYYALPGYLFPILTFFSWVCWAWPNSITAQQVGSGYHGLGVGAFTLDWAGISAYHGSPLVAPWSSILNVGVGFIMFIYIVVPVCYWKFNTFDARKFPIFSNQLFTTSGQKYDTTKILTPQFDLDIGAYNSYGKLYLSPLFALSIGSGFARFTATLTHVALFNGRDIWRQTWSAVNTTKLDIHGKLMQSYKKVPEWWFYVLLAGSVAMSLLMSFVWKESVQLPWWGMLFAFALAFIVTLPIGVIQATTNQQPGYDIIGQFIIGYILPGKPIANLIFKIYGRISTVHALSFLADLKLGHYMKIPPRCMYTAQLVGTVVAGVVNLGVAWWMLESIQDICDIEGDHPNSPWTCPKYRVTFDASVIWGLIGPRRLFGPGGMYRNLVWLFLIGAVLPVPVWALSKIFPNKKWIPLINIPVISYGFAGMPPATPTNIASWLVTGTIFNYFVFNYHKRWWQKYNYVLSAALDAGTAFMGVLLFFALQNAGHDLKWWGTEVDHCPLASCPTAPGIKAKGCPVF

SEQ ID NO: 3666 - protein, 735 aa, Unknown
  Sequence found in Organisms: Brassica napus, Brassica juncea, Brassica rapa
MDAEKASNDNNGHVEHERCPVEEVALVVPETDDPTLPVMTFRAWFLGLSSCVLLIFLNTFFTYRTQPLTISAILMQIAVLPIGKFMARTLPTTSHRLMGWEWSLNPGPFNIKEHVIITIFANCGVAYGGGDAYSIGAITVMKAYYKQSLSFICGLFIVLTTQILGYGWAGILRRYLVDPVDMWWPSNLAQVSLFRALHEKEHKSKGLTRMQFFLVALGASFLYYALPGYLFPILTFFSWVCWAWPNSITAQQVGSGYHGLGVGAFTLDWAGISAYHGSPLVAPWSSILNVGVGFIMFIYIIVPVCYWKFDTFDARKFPIFSNQLFTSAGQKYDTTKILTPRFDLDINAYNNYGKLYLSPLFALSIGSGFARFTATLTHVALFNGRDIWRQTWSAVKTVKLDIHGKLMQRYKQVPEWWFYVLLVGSVALSLLMSFVWKESVQLPWWGMLFAFAMAFIVTLPIGVIQATTNQQPGYDIIGQFIIGYILPGKPIANLIFKIYGRISTVHALSFLADLKLGHYMKIPPRCMYTAQLVGTVVAGVVNLGVAWWMLESIQDICDIEGDHPNSPWTCPKYRVTFDASVIWGLIGPKRLFGAGGMYRNLVWLFLIGAVLPVPVWAMSKIFPDKKWIPLINIPVISYGFAGMPPATPTNIASWLVTGTIFNYFVFNYHKRWWQKYNYVLSAALDAGTAFMGVLLFFALQNAGHDLKWWGTEVDHCPLASCPTAPGIIAKGCPVF

SEQ ID NO: 3667 - protein, 745 aa, Eucalyptus grandis
MATKDQTQDPEKPKKDLSEEAEEEVERCPVEEVALVVPETDDPSLPVMTFRVWTLGLASCIILIFLNTFFTFRTQPLTISAILMQIAVLPIGRFMAKTLPSREYKVLGYGFSLNPGPFNMKEHVIITIFANCGVSIGGGDAYSIGAITVMKAYYKQNLSFLCGLVIVLTTQILGYGWAGLLRKYLVDPVEMWWPANLAQVSLFRALHEREHKTRGFTRMQFFLMAMGASFVYYALPGYLFPILTFFSWVCWAWPHSITAQQVGSGYHGLGVGAFTLDWAGISAYHGSPLVSPWHSIANVAIGFIMFIYIIVPVCYWKYNTFDARKFPIFSNQLFKSDGLKYDTTKILTPEFDLNVSAYESYGKLYLSPLFALSIASGFARFTATLTHVALFHGSEIMKQSRAAIKNAKLDIHAKLMQSYKQVPQWWFLILLLGSAVVSLMMSFVWKDEVQLPWWGMLFAFGLAFIVTLPIGVIQATTNQQPGYDIIAQFLIGYVLPGKPIANLLFKIYGRISTIHALSFLSDLKLGHYMKIPPRCMYTAQLVGTLVSGVVNLAVAWWMLDGIENICDVEALHPDSPWTCPKYRVTFDASVIWGLIGPRRLFGPGGLYRNLIWLFLIGAVLPVPIWALSKMFPEKKWIALINIPVISYGFAGMPPATPTNIASWLITGTIFNYFVFRYRKRWWQKYNYILSAALDAGTAFMGVLLFFALQNENKNLKWWGTDIDHCPLASCPTAPGISVPNCPVFN

SEQ ID NO: 3668 - protein, 735 aa, Brassica juncea
MDAEKASNDNNGHVEHERCPVEEVALVVPETDDPTLPVMTFRAWFLGLSSCVLLIFLNTFFTYRTQPLTISAILMQIAVLPIGKFMARTLPTTSHRLMGWEWSLNPGPFNIKEHIIITIFANCGVAYGGGDAYSIGAITVMKAYYKQSLSFICGLFIVLTTQILGYGWAGILRRYLVDPVDMWWPSNLAQVSLFRALHEKEHKSKGLTRMQFFLVALGASFLYYALPGYLFPILTFFSWVCWAWPNSITAQQVGSGYHGLGVGAFTLDWAGISAYHGSPLVAPWSSILNVGVGFIMFIYIIVPVCYWKFDTFDARKFPIFSNQLFTSAGQKYDTTKILTPRFDLDINAYNNYGKLYLSPLFALSIGSGFARFTATLTHVALFNGRDIWRQTWSAVKTVKLDIHGKLMQRYKQVPEWWFYVLLVGSVALSLLMSFVWKESVQLPWWGMLFAFAMAFIVTLPIGVIQATTNQQPGYDIIGQFIIGYILPGKPIANLIFKIYGRISTVHALSFLADLKLGHYMKIPPRCMYTAQLVGTVVAGVVNLGVAWWMLESIQDICDIEGDHPNSPWTCPKYRVTFDASVIWGLIGPKRLFGAGGMYRNLVWLFLIGAVLPVPVWAMSKIFPDKKWIPLINIPVISYGFAGMPPATPTNIASWLVTGTIFNYFVFNYHKRWWQKYNYVLSAALDAGTAFMGVLLFFALQNAGHDLKWWGTEVDHCPLASCPTAPGIIAKGCPVF

SEQ ID NO: 3669 - protein, 738 aa, Phalaenopsis aphrodite
MVRNESLTPPVASEEDGAERCAVEEVALVVPETDDPSMPVMTFRAWFLGLTCCVLLIFLNTFFTFRTQPLTISAILMQIAALPLGRFMAGVLPRKEVRVFRGWSFNLNPGPFNIKEHVIITIFANCGVSIGGGDAYSIGAVAVMKVYYKQTLSFLCGLIIVLTTQILGYGWAGMLRRYLVDPAEMWWPSNLAQVSLFRALHERNLSSKGLTRMQFFFIFLTASFAYFTLPGYLFPILTFFSWICWIWPHSITAQQIGSGYHGLGVGAFTLDWAGISAYHGSPLVTPWFSILNTAVGFIMFIYIIMPLCYWSFNTFDARKFPIFSNQLFTSKGQKYDTTKILTPSFELNEAAYNDYGKLYLSPLFAISIGSGFLRFTATLTHVLLFNGRDIWRQSKSAVNSAKLDIHAKLMNNYKQVPQWWFLVLLAGSIGLSLLVSFVWKEEVQLPWWGMLFAFGLAWVVTLPVGVIQATTNQQPGYDIIAQFMIGYVLPGKPIANLLFKIYGRISTIHALSFLSDLKLGHYMKIPPRCMYTAQLVGTVVAGIVNIAVAWWMIKSIENICDVDALHPSSPWTCPKYRVTFDASVIWGLIGPARLFGHNGMYRNLVWLFLVGALLPVPVWLFSKMFPEKKWIPLINIPVISYGFAGMPPATPTNIASWLVTGTIFNYFVFRYRKNWWQKYNYVLSAALDAGTAFMGVLLFFALQNENRNLKWWGTEIDHCPLASCPTEPGIVVKGCPVF

SEQ ID NO: 3670 - protein, 737 aa, Arabidopsis thaliana
MDAEKATDKTNVHLSSDHERCPVEEVALVVPETDDPSLPVMTFRAWFLGLTSCVLLIFLNTFFTYRTQPLTISAILMQIAVLPIGKFMARTLPTTSHNLLGWSFSLNPGPFNIKEHVIITIFANCGVAYGGGDAYSIGAITVMKAYYKQSLSFICGLFIVLTTQILGYGWAGILRRYLVDPVDMWWPSNLAQVSLFRALHEKENKSKGLTRMKFFLVALGASFIYYALPGYLFPILTFFSWVCWAWPNSITAQQVGSGYHGLGVGAFTLDWAGISAYHGSPLVAPWSSILNVGVGFIMFIYIIVPVCYWKFNTFDARKFPIFSNQLFTTSGQKYDTTKILTPQFDLDIGAYNNYGKLYLSPLFALSIGSGFARFTATLTHVALFNGRDIWKQTWSAVNTTKLDIHGKLMQSYKKVPEWWFYILLAGSVAMSLLMSFVWKESVQLPWWGMLFAFALAFIVTLPIGVIQATTNQQPGYDIIGQFIIGYILPGKPIANLIFKIYGRISTVHALSFLADLKLGHYMKIPPRCMYTAQLVGTVVAGVVNLGVAWWMLESIQDICDIEGDHPNSPWTCPKYRVTFDASVIWGLIGPRRLFGPGGMYRNLVWLFLIGAVLPVPVWALSKIFPNKKWIPLINIPVISYGFAGMPPATPTNIASWLVTGTIFNYFVFNYHKRWWQKYNYVLSAALDAGTAFMGVLLFFALQNAGHDLKWWGTEVDHCPLASCPTAPGIKAKGCPVF

SEQ ID NO: 3671 - protein, 752 aa, Solanum phureja
MSLKNSVQPPPLSAADGGGKLNGDTLSSDDDRCPVEEVALVVPETDDPTLPVMTFRAWFLGLSSCTILIFLNTFFIYRTQPLTISAILMQIAVLPIGKFMAATLPKKNFALFGRWGSFSLNPGPFNIKEHVVITVMANCGVSIGGGDAYSIGAITVMRAYYNQSVSFLCSLIIVLTTQILGYGWAGMLRRYLVDPVDMWWPSNLAQVSLFRALHEKEPKTRSLTRMKFFLVFMAASFAYYALPGYLFPILTFFSWVCWAYPHSITAQQIGSGYHGLGVGAFTLDWAGISAYHGSPLVTPWSSILNVAVGFIMFIYIIIPLCYWKYNTFDAQKFPIFSNQLFTASGHKYDTTKILTPQFDLNIAAYEKYSKLYLSPLFALSIGSGFARFTATLTHVALFHGSDIWKQSRSAVKNVKMDIHAKLMKSYKQVPQWWFLALLVGSIALSLLMCFVWKEDVQLPWWGLLFAFGLAFVVTLPIGVIQATTNQQPGYDIIAQFIIGYILPGKPIANLLFKIYGRTSTVHALSFLADLKLGHYMKIPPRCMYTAQLVGTLVAGTINLAVAWWMLGSIDNICDVEALHPDSPWTCPKFRVTFDASVIWGLIGPERLFGPGGLYRNLVWLFLIGALLPVPIWVLSKMFPEKKWIPLINIPVISYGFAGMPPATPTNIASWLITGMIFNYFVFKYRKEWWKKYNYVLSAALDAGTAFMGVLLFFALQNEGKNLKWWGTELDHCPLATCPTAPGIIVQGCPVFK

SEQ ID NO: 3672 - protein, 735 aa, Eutrema parvulum
MDSEKANNEKNGHLEHERCPVEEVALVVPETDDPTLPVMTFRAWFLGLTSCVLLIFLNTFFTYRTQPLTISAILMQIAVLPIGKFMARALPTTSHKLMGWEFSLNPGPFNIKEHVIITIFANCGVAYGGGDAYSIGAITVMKAYYKQSLSFICGLFIVLTTQILGYGWAGILRRYLVDPVDMWWPSNLAQVSLFRALHEKEHKSKGLTRMQFFLMILGASFLYYALPGYLFPILTFFSWVCWAWPQSITAQQVGSGYHGLGVGAFTLDWAGISAYHGSPLVAPWSSILNVGVGFIMFIYIIVPVCYWKFNTFDARKFPIFSNQLFTSTGQKYDTTKILTPRFDLDINAYNNYGKLYLSPLFALSIGSGFARFTATLTHVALFNGRDIWKQTWSAVKTAKLDIHGKLMQSYKQVPEWWFYVLLVGSVAMSLLMSFVWKESVQLPWWGMLFAFAMAFIVTLPIGVIQATTNQQPGYDIIGQFIIGYIMPGKPIANLIFKIYGRISTVHALSFLADLKLGHYMKIPPRCMYTAQLVGTVVAGVVNLGVAWWMLESIQDICDIEGEHPNSPWTCPKYRVTFDASVIWGLIGPKRLFGAGGMYRNLVWLFLIGAVLPVPVWAMSKIFPNKKWIPLINIPVISYGFAGMPPATPTNIASWLVTGTIFNYFVFNYHKRWWQKYNYVLSAALDAGTAFMGVLLFFALQNAGHDLKWWGTEVDHCPLASCPTAPGIRAKGCPVF

SEQ ID NO: 3673 - protein, 220 aa, Panicum virgatum
MIRLQTYAAFSLLATASAVYYAFSSRDQFYPAMVYLSTSKICFVLLLNTGLVAMCVAWQLVKRLFLGSLREAEVERLNEQSWREVVEILFAVTIFRQDFSVSFLAMVAALLLVKALHWLAQKRVEYIETTPSVPMLSHIRIVSFMAFLLIVDCLFLSNSLRSLIDKREASVAIFFSFEYMILATSTVSTFVKYIFYVSDMLMEGQWEKKAVYTFLFGTHQ

SEQ ID NO: 3674 - protein, 503 aa, Zea mays
MIRLPMYAAFSLLATASAAYYAFSSREQFYPAMVYLSTSKICFVLLLNTGLVAMCVAWQLARRLFLGSLREAEVERLNEQSWREVIEILFAVTIFRQDFSVSFLAMVAALLLVKALHWLAQKRVEYIETTPSVPLLSHIRIVSFMVFLLTVDCLFLSNSLRSLIQKREASVAIFFSFEYTILATSTLSTFVKYIFYVSDMLMEGQWERKAVYTFYLELISDLVHLSLYMLFFIAIFLNYGVPLHLIRELYETFRSFRIRIADYIRYRKITSNMNERFPEATSEELDASDATCIICREEMTTAKKLLCGHLFHVHCLRSWLERQHTCPTCRAPIVPADNGRAASSRQHGAQAGVQPGTATPSSEGAPGENMSRRQAKLEAAAAAASLYGRSFVYPPANTLNSRSGSPQPTSSAPQSEASSSNHQSQKDQETQLQNSSDGLVPLPFSADGVVGSGTSTRDLENSLQKAQENFIKSQIEMLQIQLQMVQRGAAGLSSSENTEHTED

SEQ ID NO: 3675 - protein, 635 aa, Setaria italica
MDGSAAELEAAERVVMRWDSASAGAGADEPMLFDGAGDRAEADRFLRAVDDLRRLAPPSPAAVGSPRRLSSSSVSSAAAGSGAVQVAMARLEDEFRHVLSSRALDLEIEALADLSSLSINSDRSNSASSADLPAADEDDSVSASIGRRSSAYRSLRSIREIDLLPDDAVADLRAIASRMAAAGYGRECAQVYASVRKPAVDASLRRLGVERLSIGDVQRLEWDALEAKIRRWIRAARAAVRGVFASERRLCFHIFHDLPISSSTISAAAAPATHDTPFAEAVKGAALQLFGFAEAISIGRRSPEKLFKIIDLHDALSDLLPDVSDIFAASKAAESIYVQAVEIRSRLADAVRGILSEFENAVLRDPPKTAVPGGTIHPLTRYVMNYSSLICDYKVTLSELIVSRPSASARLAAEGNELVPSLADLELPELENQLPLASHIVWIIVVLEHNLEGKAALYKDLALSHLFMMNNVHYIVHKVKDSPDLWGMIGDDYLKRLTGKFTMAATNYQRTSWLKILNCLRDEGLHVSGGFSSGISKSALRERFKSFNAAFEDAHRVQSGWCVPDNQLREELRISIAEKLLPAYRSFLGRFRHHIENGKHPELYIKYSVEDLEIAVGDFFEGVPPSPHNRRRSHG

SEQ ID NO: 3676 - protein, 626 aa, Zea mays
MDGSAAELEAAERVVMRWDSSLACGGTDEPMLFDGGGNRAEADRFLRAVDDLRRLAPPSPAVVGSPRRLSSSSAARSGAVLVAMTRLEDEFRHVLSSRALDHEIEALADLSSLSINGDRSNSASSADLSAADEDDSVSSSIGRRSTAYRSLRSIREIDLLPDDAVADLRAIASRMAAAEHGRECAQVYASVRKPSVDASLRRLGVERLSIGDVQRLEWDALEAKIRRWIRAARAAVRGVFASERRLCFHIFHDLPISAASAPATHDTPFAEAVKGAALQLFGFAEAISIDRRSPEKLFKIIDLHDALSDLLPDVSDIFAASKVAESIYVQAVEIRSRLADAVRGIFSEFENAVLHDPPKTAVPGGTVHPLTRYVMNYSSLICDYKATLSELIVSRPSASARLAAEGNELVPSLADLELPELENQLPLASHIVWIIVILEHNLEGKATLYKDPALSHLFMMNNVHYIVHKVKDSPDLWGMIADDYLKRLTGKFTMAATNYQQASWLKILNCLRDEGLHVSGGFSSGISKSALRERFKSFNAAFEDAHRVQSGWCVPDNQLREELRISIAEKLLPAYQSFLGRFRHHIENGKHPELYIKYSVEDLEIAVGDFFEGVPPSPHHRRRSHG

SEQ ID NO: 3677 - protein, 632 aa, Oryza sativa
MDGSAELEAAERVVMRWDSTSASDEPMLFDGARAEAERFLRAVDDLRRLAPPSPAAVGSPRRLSSGSSSVSAGGGGGAATAVQVAMARLEDEFRHVLSSRALDLEIEALADLGGSLSISSDRSNSASSAELQVVDEDDSVSSLVGRRSSYRSLPSIREIDLLPDDAVSDLRAIASRMAAAGYGRECAQVYASVRKPAVDASLRRLGVERLSIGDVQRLEWKALEAKIRRWIRAARAAVRGVFASERRLCFLIFHDLPISNITVTAAAPATHDTPFAEAVKGAALQLFGFAEAISIGRRSPEKLFKIIDLHDALSDLLPDVSDIFAASKVAESIYVQAAEIRSRLADAVRGILSEFENAVLRDPPKTAVPGGTVHPLTRYVMNYSSLISDYKVTLSELIVSRPSASARLAAEGNELAPSLAELDLPEPDNQTPLAAHIIWIIVVLEHNLEGKASLYRDTALSHLFLMNNVYYIVHKVKDSPDLWNLIGDDYLKRLTGKFTMAATNYQRSAWLKILNCLRDEGLHVSGGFSSGISKSALRERFRSFNAAFEEAHRVQSGWCVPDTQLREELRISISEKLVPAYRSFLGRFRHHIENGKHPELYIKYSAEDLEIAVNDFFEGVPPSPHIRRRSHS

SEQ ID NO: 3678 - protein, 643 aa, Brachypodium distachyon
MDGSAELEAAERVVMRWDSSSASASAAAAAAAADEPMLFDGAGDRAEAERFLRAVDDIRRLAPPSPASVGSPRRLSSGSSALGGAGCSAAQVAMARLEDEFRHVLSSRAFDLEIEALADLTSLSSISTDRSNSVSSIDLPVVEEDDPVSYAVGRRSSYRSLRSIREIDLLPDDAVADLRAIASRMAAAGYGRECAQVYASVRKPAVDASLRRLGVERLSIGDVQRLEWEALEAKIRRWIRAARAAVRGVFASERRLSFHIFHDLPISNVAVAAAVPAAAATHDTPFAEAVKGAALQLFGFAEAISIGRRSPEKLFKIIDLHDALSDLLPDVSDIFAASKAAESIYVQAVEIRSRLADAVRGILSEFENAVLRDPPKTAVPGGNVHPLTRYVMNYSSLISEYKATLSELIVSRPSASARLAAEGNELAPSLAELELPELDNQSPLSAHIIWIIVVLEHNLEGKASLYKDTALSHLFLMNNVHYIVHKVKDSPELWSMIGDDYLKRLTGKFTVAATHYQRTSWLKILNCLRDEGLHVSGGFSSGISKSALRERFKSFNAAFEDAHRVQSGWSVPDTQLREELRISISEKLLPAYRSFLGRFRHHIENGKHPELYIKHSAEDLEIAVNDFFEGVTPSPHNRRRSHG

SEQ ID NO: 3679 - protein, 267 aa, Secale cereale
AAGGGGCSAVQVTMARLEDEFRHLLSSRAFDLEIEALADLTSLSISSDRTNSVSSMDLPAVEEDDSISYCGGRRSSYRSLRSIREIDLLPDDAVADLRAIASRMAAAGYGRECVQVYASVRKPAVDASSAGSASNGSASVMSSASSGTLSRPRSADGSELPVPPSAAFLPASAASPSTSSMTSQSPMSPLSASSPRLQPRMTPPSSKLSRVRHFSCLASLRPSASVAALPRSSSRSSISTTRYLTCSLTSPTFSLHPRQPNRYTCRP

SEQ ID NO: 3680 - protein, 644 aa, Hordeum vulgare
MDGSAELEAAEQVVIRWNSSLASTAAAAAAAAAAAVEYEPMLFDGAGDRTEAERFLRAVDNIRRLAPSSPSVVGSPRRLSSGSGAAAGGGGCSAVQVTMARLEDEFRHLLSSRAFDLEIEVLADLTSLSISSDRTNSVSSMDLPAVEEDDSVSYCGGRRSIYRSLRSIREIDLLPDDAVADLRAIASRMAAAGYGRECAQVYASVRKPAVDASLRRLGVERLSIGDVQRLGWDALEAKIRRWIRAARAAVRGVFASERRLSFHVFHDLPISNVTVVTAAPATRDTPFVEAVKGAALQLFGFAEAISIGRRSPEKLFKIIDLHDALSDLLPDVSDIFGASKAAESIYVQAVEIRSRLADAVRGILSEFENAVLRDPPKTAVPGGTIHPLTRYVMNYSSLISEYKATLTELIVSRPSASTRLAAEGNELVPSLCYLELPEHENQSPLAAHIIWIIVVLEHNLESKASLYKDTALSHLFLMNNIHYIVHKVKDSPDLWSMIGDDYLKRLTGKFTVAATNYQRTSWLKILNCLRDEGLHVSGGFSSGISKSALRERFKSFNAAFEDAHRVQSGWFVPDTQLREELRISISEKLLPAYRSFLGRFRHHIENGKHPELYIKHSAEDLENAVNDFFEGAPPSPHNRRKSHG

SEQ ID NO: 3681 - protein, 637 aa, Oryza sativa
MDGSTAAAAELEAAERVVMRWDSTASASYGGGGGDEQMLFDGGGDRVEAERFLRAVDDLRRLAPPSPATVGSPRRTSSASGGGGAASNAVQVAMARLEDEFRHVLSSRALDLEIEALADLTSLSMCSDRTNSADVAEEAAAADEDDSVSSSVGRRSSYRSLRSIREIDLLPADAISDLHAIASRMAVAGYGRECVQVYASVRKPAVDSALRRLGVEKLSIGDVQRLEWEVLEAKIRRWIRAARAAVRGVFASERRLCFLIFHDLPLSSSTITTATHDAPFAEAVKGAALQLFGFAEAISIGRRSPEKLFKIIDLHDAIADLLPDVSDIFAASKAGESIYVQAAEIRSRLADAVRGILSEFENAVLRDPSKTPVPGGTIHPLTRYVMNYSSLISDYKTTLSELIVSRPLACSRIAPEGNENAPSFPDLDLADPDSQLPLAAHLIWIIVVLEHNLESKASLYKDAALSHLFVMNNVHYIAHKIKDSPELRGLIGDEYLKQLTGKFRLAATRYQRTAWLKILNCLRDEGLHVSGGFSSGVSKSALRERFKSFNAAFEEAHRVQSAWYVPDTQLREELRISIAEKLLPAYRSFLGRFRHHIENGRHPELYIKYSVEDLETSVTNFFEGCPPSLHNRRRSHG

SEQ ID NO: 3682 - protein, 544 aa, Oryza sativa
MARLEDEFRHVLSSRALDLEIEALADLTSLSMCSDRTNSADVAEEAAAADEDDSVSSSVGRRSSYRSLRSIREIDLLPADAISDLHAIASRMAVAGYGRECVQVYASVRKPAVDSALRRLGVEKLSIGDVQRLEWEVLEAKIRRWIRAARAAVRGVFASERRLCFLIFHDLPLSSSTITTATHDAPFAEAVKGAALQLFGFAEAISIGRRSPEKLFKIIDLHDAIADLLPDVSDIFAASKAGESIYVQAAEIRSRLADAVRGILSEFENAVLRDPSKTPVPGGTIHPLTRYVMNYSSLISDYKTTLSELIVSRPLACSRIAPEGNENAPSFPDLDLADPDSQLPLAAHLIWIIVVLEHNLESKASLYKDAALSHLFVMNNVHYIAHKIKDSPELRGLIGDEYLKQLTGKFRLAATRYQRTAWLKILNCLRDEGLHVSGGFSSGVSKSALRERFKSFNAAFEEAHRVQSAWYVPDTQLREELRISIAEKLLPAYRSFLGRFRHHIENGRHPELYIKYSVEDLETSVTNFFEGCPPSLHNRRRSHG

SEQ ID NO: 3683 - protein, 627 aa, Setaria italica
MEASAAAKLEAAERVVMRWDSTASAASSAAGDEQAMLFDGAGDRAEAERFLRAVDDIRRLAPPQSAGCACAAVQVAMARLEDELRHVLAARALDLEIEALAGLTSLSMSGDRRNSDATEVAAAAGDDDDGGGGSVSSSVGRRSSYRSLPSIREIDLFPADAISDLHAIASRMAEAGFGRECVQVYASVRKPAVDSALRRLGVEKLSIGDVQRLEWDALEAKIRRWIRAACAAVRGVFASERRLCFHIFHDLPLCSSTATSAGTATHDAPFAEAVKGAALQLFGFAEAISIGRRSPEKLFKIIDLHDALSDLLPDISDIFAASKAAESIYVQAAEIRSRLADAVRGILSEFENAVLRDPSKTPVPGGTIHPLTRYVMNYSSLISDYKTTLSELIISRPSASSRIATEGNEAAPAFPDLDLPDPDSQLPLAAHLIWIIVVLEHNLESKASLYKDAALSHLFLMNNVHYIVHKVKDSAELRGLIGDEYLRRLTGKFRQAATSYQRTAWLKILNCLRDEGLHVSGGFSSGISKSALRERFKAFNAAFEEAHRIQSTWYVPDTQLREELRISISEKLLPAYRSFLGRFRHHIENGRHPELYIKYSVEDLEIAMADFFEGAPPSPHNRRRSHG

SEQ ID NO: 3684 - protein, 459 aa, Triticum aestivum
MAAAGYGRECAQVYASIRKPAVDASLRRLGVERLSIGDVQRLEWDALEAKIRRWIRAARAAVRGVFASERRLSFHVFHDLPISNVTVVSVVTAAPATHDTPFVEAVKGAALQLFGFAEAISIGRRSPEKLFKIIDLHDALSDLLPDVSDIFAASKAAESIYVQAVEIRSRLADAVRGILSEFENAVLRDPPKTAVPGGTVHPLTRYVMNYSSLISDYKATLTELIVSRPSASARLAAEGNELAPSLSCLELPEHENQSPLAAHIIWIIVVLEHNLESKVSLYKDTALSHLFLMNNVHYIVHKVKDSPDLWSMIGDDYLKRLTGKFTVAATNYQRTSWLKILNCLRDEGLHVSGGFSSGISKSALRERFKSFNAAFEDAHRVQSGWFVPDTQLREELRISISEKLLPAYRSFLGRFRHHIENGKHPELYIKHSAEDLENAVNDFFEGAPPSPHNRRRSHG

SEQ ID NO: 3685 - protein, 627 aa, Hordeum vulgare
MDGSAAAELERAERVVMRWDSTASAPAGGGEDQMLFDGGGDRAEAERFLQAVDDLRRLAPPSPGSPRRTSSSGASGAVQVAMARLEDEFRHVLASRAVDLEIEVLADLSSLSMCSDRSSFSDVGDAPPVDDDSVEFSVGRRSSYRSMRSIREIDLLPPDAVADLNAIASRMAAAGYDRECVQVYASVRKPAVDSALRRLGVEKLTIGDVQRLEWDALEVKIRRWIRAARAAVRGVFASERRLCFLIFHDLPLSNPTIATPAPTTTPAAPFVETVKGAALQLFGFAEAISIGRRSPEKLFKIIDLHDALADLLPDVSDIFAVSKAGESIYVQSTEIRARLADAVRGILSEFENAVLRDPSKTPVPGGTIHPLTRYVMNYIVLISDYKATLSELIVSRPSASSRVSADGNELTPSFPDLDLADPDSQLPLSAHLIWTIVVLEHNLEGKASLYKDPALSHLFLMNNVHYIVHKVKDSPELRGLIGNEYLKRLTGKFRLAATAYQRSSWLKILNCLRDEGLHVSGGFSSGISKSALRERFKSFNAAFEEAHRAQSGWYVPDTQLREELRISISEKLLPAYRSFLGRFRHHIENGRHPELYIKYTVEDLEISVTDFFEGSPPPPHNRRRSHG

SEQ ID NO: 3686 - protein, 637 aa, Zea mays
MEGFAAAELEAAERLVKRWDSTASAASSAGRGGDNQMLFDGAADRAEAERFLRAVDDLRRLAPPSPASVGSPRRASSAGGVCTAVEVAMTRLEDEFRHVLSARALDLEIEALAGLSSLSMASGRSNSDATEAAAGEEDDGSVSSSVGRRSSYRSLQSIREIDLFPADAISDLHAIASRMAAAGYGRECVQVYASVRKPAVDSALRRLGVEKLSIGDVQRLEWDALEAKIRRWIRAARAAVRGVFASERCLCLHIFNDLPLRTSTATAAAAAAPTNHDAPFAEAVKGAALQLFGFAEAISIGRRSPEKLFKIIDLHDALSDMLPDISDIFADSKAAESIYVQAAEIKSRLVDAVRGILSEFENAVLRDPSKTPVPGGTIHPLTRYVMNYSTLISDYKATLSELIISRPSASPQTAAEENEATPAFPDLDPPDPDSQLPLATHLVWIIVVLEHNLESKASLYKDAPLSHLFLMNNVHYIVHKVKDSAELRGLIGDEYLRRLTGKFRQAATSYQRTAWLKILNCLRDEGLHVSGGFSSGVSKSALRERFKAFNAVFEEAHRVQSAWYVPDTQLREELRISVLEKLLPAYRSFLGRFRHHIENSRHPELYIKYSVDDLEIAMADFFEGSPPSLHNRRRSHG

SEQ ID NO: 3687 - protein, 635 aa, Brachypodium distachyon
MDRSAAVELERAERVVMRWDSTASASTGGGSGGEEQMLFDGGGDRAEAERFLLAVDDLRRLAPASPGAVGSPRRTSSAGGGSNAVQVAMARLEDEFRHVLTSRALDLEIEVLADLSSLSMCSDRTSFSDFPEPVAAAGDDDDSVSSSVGRRSSYRSMRSIREIDIFPADAISDLNAIACRMAAAGYDRECVQVYASVRKPAVDSALRRLGVEKLTIGDVQRLEWDALEAKIRRWIRAARAAVRGVFSSERRLCFLIFHDLPLSNPNSPITSPNPTTPFAETVKGATLQLFGFAEAISIGRRSPEKLFKIIDLHDALSDLLPDVSDIFAASKAGESIYVQVAEIRSRLADAVRGILSEFENAVLRDPSKTPVPGGTIHPLTRYVMNYISLISDYKATLSELILSRPSSSSRNAAEGNDLTPSFPDLDLPDPDSQSPLAAHLIWIIVVLEHNLEGKASLYKDVSLSHLFLMNNVHYIVHKVKDSPELRGLIGDTYLKRLTGKFRLAATSYQRTAWLKILNCLRDEGLHVGGGFSSGISKTALRERFKAFNAVFEEAHRVQSGWYVPDTQLREELRISISEKLLPAYRSFLGRFRHHIENGRHPELYIKYSVDDLEISVTDFFEGSPPPPHNRRRSHG

SEQ ID NO: 3688 - protein, 622 aa, Sorghum bicolor
MEGSAAEELEAAERVVMRWDSTASSAGGDDQMLFDGAADRAEAERFLRAVDDLRRLAPPATVGTPRRAALQVAMARLEDEFRHVLSARALDLEIEALAGLSSLSISSSDPRNSDATEAAATGGDDDDTSSASSSVGRRSSYRSLQSIREIDLFPVDAISDLQAIASRMAAAGYGRECVQVYASVRKPAVDAALRRLGVEKLSIGDVQRLEWDALEAKIRRWIRAARAAVRGVFASERRLCFHIFHDLPLCTSTATATAADDAPFAEAVKGAALQLFGFAEAISIGRRSPEKLFKIIDLHDALADMLPDISDIFAASKAAESIYVQAAEIRSRLADAVRGILSEFENAVLRDPSKTPVPGGTIHPLTRYVMNYSTLISDYKATLSELIISRPSANSRTAAGGNEATPAFPDLDPPDPDSQLPLATHLVWIIVVLEHNLESKASLYKDAALSHLFFMNNVHYMVHKVKDSAELRGLIGDGYLKRLTGKFLQAATSYQRTAWLKILNCLRDEGLHVSGSFSSGISKSALRERFKAFNAAFEEAHRVQSVWYVPDTQLREELRILISDKLLPAYRSFLGRFRHHIENSRHPELYIKYTVEDLEIAMADFFEGSPPSSPHNRRRSHG

SEQ ID NO: 3689 - protein, 638 aa, Zea mays
MEASAAEELAAAKRVIMRWDSTASAACSAGGDDQMLFDGAANRAEAERFLRAVDDLRRLAPPSPASVGSPRRASAAGGVCDAVQVAMARLEDEFRHVLSARALDLEIEALAGLSSLSMASDRRNSDATEEAAAGDDDGSGGGGGSSVSSSVGRRSSYRSLQSIREIDLFPADAISDLHAIAYRMAAAGYGRECVQVYASVRKPAVDSAMRRLGVEKLSIGDVQRLEWDSLEAKIRRWICAARAAVRGVFASERRLCFHIFHDLPLRTSTATAAYATNQDAPFAEAVKGAALQLFGFAEAISIGRRSTEKLFKIIDLHDALSDMLPDISDIFAASKATESIYVQAAEIRSRLADAVRGILSEFENAVLRDPSKTPVPGGTIHPLTRYVMNYISLISDYKATLSELVISRPSASSRTAAEGNEATPSFPDLDPPDPDSQLPLAAHLIWIIVVLEHNLESKASLYKDAALSHLFLMNNVHYIVHKVKDSAELRGLIGNEYLKRLTGKFRQEATRYQRTAWLKILNCLRDEGLHVSGGFSSGISKSALRERFKAFNAAFEEAHRVQSAWYVPDTQLREELRISISEKLLPAYRSFLGRFRHHIENSRHPELYIKYSVEDLEITMADFFEGSPPPHNRRRSHG

SEQ ID NO: 3690 - protein, 564 aa, Sorghum bicolor
MSSKKNYYKEKMMRRKEEKKEEPETPRYRDRAKERREDQNPDYEPTELGSFHAVAPPGTDLRLADAHKISIEKSKYLGGDLEHTHLVKGLDYALLHKVRSEIEKKPDAEDGKDAKSRATKEDQAISFRTATAKSVYQWIIKPQSIIKENELFLPGRMSFIYNMEEGVTNDIPTTLHRSKADCPIPEEMVTVSVDGSVLDRIAKIMTYLRLGSSGKVLKKKKKERDIKGKSNLASGDYDESVKPSQINGSTLKHQSDMPPPPAPPPRNNNFNGKEKQPVPVSRADDDDIFVGDGVDYSVPNKEMSQSPVSDMDESPHNHQKQSNFTEPMYGPVPPSEPAQAWQQQNGYDAVQAQMAAAGYQGDWSSYVYAEQQLGYPEQYVQQSTQEYDVLADPSLSQDPRFMTQADKDRGLGSVFKRDDQRLNQLREKDARERDPNFISDSYSECYPGYQEYNNEIAGSDDEDDLSKMDMGGRAKGRLHRWDFETEEEWAKYNDQKEAMPKAAFQFGVKMQDGRKTRKQNKDQKLTNDLHKINKILARKKGEKDGAEDGGHYDDDLPSSKKQRG

SEQ ID NO: 3691 - protein, 567 aa, Setaria italica
MSSKKNYYKEKMMRRKEEKKEEPETPRYRDRAKERREDQNPDYEPTELGSFHAVAPPGTDLRLADAHKISIEKSKYLGGDLEHTHLVKGLDYALLHKVRSEIEKKPDAEDGKDAKSRATKEDQAVSFRTAAAKSVYQWIIKPQSIIKENELFLPGRMSFIYNMEEGLTNDIPTTLHRSKADCPVPEEMVTVSVDGSVLDRIAKIMTYLRLGSSGKVLKKKKKERDSKGKNNLASGDYDEAVKPSQTNGSALKHQSEKNMPPPPPPPARNDNFNGKEKQPVPISRADDDDIFIGDGVDYTVPNKEMSQSPVSEDMDESPHNHQKQSYFTEPMYGPVPPSEPAQAWQQPSGYDAVQAQMVAAGYQGDWSGYAYAEQQMGYPEQFVQQSTQEYDVLADPSIAQDPRFMTQADKDRGLGSVFKRDDQRLNQLREKDAREKDPNFISDSYSECYPGYQEYHNEIAGSDDEDDLSKMDMGGRAKGRLHRWDFETEEEWATYNDQKEAMPKAAFQFGVKMQDGRKTRKQNKDQKLTNDLHKINKILARKKGEKDGTDDGGHYDDDLPSAKKQRG

SEQ ID NO: 3692 - protein, 567 aa, Panicum virgatum
MSSKKNYYKEKMMRRKEEKKEEPETPRYRDRAKERREDQNPDYEPTELGSFHAVAPPGTDLRLADAHKISIEKSKYLGGDLEHTHLVKGLDYALLHKVRSEIEKKPEAEDGKDAKSRSTKEDQAVSFRTATAKSVYQWIIKPQSIIKENELFLPGRMSFIYNMEEGVTNDIPTTLHRSKADCPIPEEMVTVSVDGSVLDRIAKIMTYLRLGSSGKVLKKKKKERDLKAGKNNLVSADYDKAVKPSQTNGSALKHQSQKDMPPPPAPPWNNNFNGNEKQFAPVARADDDDIFVGDGVDYSVPNKEMSQSPVSEDMDESPHNHQKQTYFTEPMYGPIPPSEPAQAWQQPNGYDAVRAQMAAAGYQGDWSGYVYAEQQLAYPVQYLQQSTQEYDVLADPSISQDPRFMTQADKDRGLGSVFKRDDQRLNQLREKDARERDPNFISDSYSECYPGYQEYNNEIAGSDDEDDLSKMDMGGRAKGRLHRWDFETEEEWAKYNDQKEAMPKAAFQFGVKMQDGRKTRKQNKDQKLTNDLNKINKILARKKGEKDGADDGGHYDDDLPSSKKQRG

SEQ ID NO: 3693 - protein, 567 aa, Panicum virgatum
MSSKKNYYKEKMMRRKEEKKEEPETPRYRDRAKERREDQNPDYEPTELGSFHAVAPPGTDLSLADAHKISIEKSKFLGGDLEHTHLVKGLDYALLHKIRSEIEKKPDAEDGKDAKSRSTKEDQVVSFRTATAKSVYQWIIKPQSIIKENELFLPGRMSFIYNMEEGVTNDIPTTLHRSKADCPIPEEMVTVSVDGSVLDRIAKIMTYLRLGSSGKVLKKKKKERDLKGKNNLVTGDYDEAVKPSQTNGSALKHQSQKDMPPPPPPPRRDNNFNGNEKQSAPVARADDDDIFVGDGVDYSVPNKEMSQSPVSEDMDESPHNHQKQTYFTEPMYGPIPPSEPAQAWQQPIGYDAVQAQVASAGYQGDWSGYVYAEQQLAYPEQYVQQSTLEYDVLADPSISQDPRFMTQADKDRGLGSVFKRDDQRLNQLREKDARERDPNFISDSYSECYPGYQEYNNEIAGSDDEDDLSKMDMGGRAKGRLHRWDFETEEEWAKYNDQKEAMPKAAFQFGVKMQDGRKTRKQNKDQKLTNDLHKINKILARKKGEKDGADDGGHYDDDLPSSKKQRG

SEQ ID NO: 3694 - protein, 573 aa, Setaria italica
MSSKKNYYKEKMMRRKEEKKEEPETPRYRDRAKERREDQNPDYEPTELGSFHAVAPPGTDLRLADAHKISIEKSKYLGGDLEHTHLVKGLDYALLHKVRSEIDKKPDAEDGKDAKSRATKEDQAVSFRTATAKSVYQWIIKPQSIIKENELFLPGRMSFIYNMEEGFTNDIPTTLHRSKADCPVPEEMVTVSVDGSVLDRIAKIMTYLRLGSSGKVLKKKKKERDTKGKNNLASGDYDEAVKPTQTNGSDLKHQSEKNMPPPPPPPPLNNNSNGKEKQSVPLARADNDDIFVGDGVDYSVPNKEMSQSPVSEDMDESPHNHQKQSYFTEPMYGPVPPSEPAQAWQQPNGYDAVQAQMVAAGYQGDWSGYAYAEQQLGYPEQYVQQSIQEYDVLADPSIAQDPSIAQDPRFMTQADKDRGLGSVFKRDDQRLNQLREKDAREKDPNFISDSYSECYPGYQEYHNEVAGSDDEDDLSKMDMGGRAKGRLHRWDFETEEEWAKYNDQKEAMPKAAFQFGVKMQDGRKTRKQNKDQKLNNDLHKINKILARKKGEKDGTDDGGHYDDDLPSAKKHRG

SEQ ID NO: 3695 - protein, 567 aa, Pennisetum glaucum
MSSKKNYYKEKMMRRKEEKKEEPETPRYRDRAKERREDQNPDYEPTELGSFHAVAPPGTDLRLEDAHKISIEKSKYLGGDLEHTHLVKGLDYALLHKVRSEIDKKPDPEDGKDAKSRVTKEDQAVSFRTATAKSVYQWIIKPQSIIKENELFLPGRMSFIYNMEEGLTSDIPTTLHRSKADCPVPEEMVTVSVDGSVLDRIAKIMTYLRLGSSGKVLKKKKKERDTKGKNNLASGDYDEAVKPTQTNGSGLKHKSEKNMPLPPPPPPRSNNSNGKEKQSVPLARADDDDIFVGDGVDYFVPNKEMSQSPVSEDMDESPHDHQKQSYFAEPMYGPVPPSEPAQAWQQPNGYDAVQAQMVAAGYQGDWSGYAYAEQQLGYPEQYVQQSIQEYDVLADPSIAQDPRVMTQADKDRGLGSVFKRDDQRLNQLREKDAREKDPNFISDSYSECYPGYQEYHSEVAGSDDEDDLSKMDMGGRAKGRLHRWDFETEEEWAKYNDEKEAMPKAAFQFGVKMQDGRKTRKQNKDQKLSNDLHKINKILARKKGEKDGTDDGGHYDDDLPSAKKHRG

SEQ ID NO: 3696 - protein, 553 aa, Pennisetum glaucum
EERGEKEEPETPRYRDRAKERREDQNPDYEPTELGSFHAVAPPGTDLRLADAHKISIEKSKYLGGDLEHTHLVKGLDYALLHKVRSEIEKKPDAEDGKDAKSRATKEDQAVSFRTATAKSVYQWIIKPQSIIKENELFLPGRMSFIYNMEEGLTNDIPTTLHRSKADCPVPEEMVTVSVDGSVLDRIAKIMTYLRLGSSGKVLKKKKKERDTKGKNSLASGDYDEAVKPSQTNGSSLKQKSEKNMPPPPLPPARNDNFNGKEKQPVPTSRADDDDIFVGDGVDYVVPNKEMSQSPVSEDMDESPHNHQKQSYFTEPMYGPVPPSEPAQAWQQPNGYDAVQAQMVAAGYQGDWSGYAYAEQQLGYPEQYVQQSTQEYDVLADPSIAQDPMFMTQADKDRGLGSVFKRDDQRLNQLREKDAREKDPNFISDSYSECYPGYQEYHNEIAGSDDEDDLSKMDMGGRAKGRLHRWDFETEEEWAKYNDEKEAMPKAAFQFGVKMQDGRKTRKQNKDQKLSNDLHKINKILARKKGEKDGADDGGHYDDDLPSAKKQRG

SEQ ID NO: 3697 - protein, 569 aa, Zea mays
MEREREREREREREREREIAEEKKKEEPETPRYRDRAKERREDQNPDYEPTELGSFHAVAPPGSDLRLADAHKISIEKSKYLGGDLEHTHLVKGLGYALLHKVRSEIEKKPEAEDGKDAKSRATKEDQAVSFRTATAKSVYQWIIKPQSIIKENELFLPGRMSFIYNLEEVVTNDIPTTLHRSKADCPVQEEMVTVSVDGSVLDRIAKIMTYLRLGSSGKVLKKKKKERDIKGKNNLASGDCDESVKPSKINGSTQKHQSDMPPPPARPPQNNNFTGKEKQPVPVARADDDDIFVGDGVDYTVPNEEMSQSPVSDMDESPHNHQKQSNFIEPMYGPVPPSEPAQAWQQPNGYDAVQAQMAAAGYQGDWSSYVYAEQQLGYPEQYVQQSTQEYDVLADPSISQDPRFMTQADKDRGLGSVFKRDDQRLNQLREKDERERDPNFISDSYSECYPGYQEYNNEIAGSDDEDDLSKMDMGGRAKGRLHRWDFETEEEWAKYNDQKEAMPKAAFQFGVKMQDGRKTRKQNKDQKLTNDLHKINKILARKKGEKDGAEDGGHYDDDLPSSKKQRG

SEQ ID NO: 3698 - protein, 567 aa, Oryza sativa
MSSKKNYYKEKMMRRKEEKKEEPETPRYRDRAKERREDQNPDYEPTELGSFHAVAPPGADLRLADAHKISIEKSKYLGGDLEHTHLVKGLDYALLHKVRSEIEKKPEAEDGKDTQSRSTKEDQAVSFRTAAAKSVYQWIIKPQSIIKSNEMFLPGRMAFIYNMEDGLTNDIPTTLHRSKADCSVPEEMVTVSVDGSVLDRIAKIMSYLRLGSSGKVLKKKKKERDTKGKNSLASGDYDEVARPGQTNGSALKHQFEKDMPPPPPPRNNNLSKNEKPSAPVARADEDDIFVGDGVYYSVPNKEMSQSPVSEDMDESPHNHQKQSYFTEEKPIYGPIPPSDPAQAWPQPNAYDAIQAQMVAAGYQGEWSGYQYGEQQMAYPEQYMQQSAQDCDVLADPNITQDPRLMTQADKDRGLGSVFKRDDERLKQLREKDAREKDPNFISDSYSECYPGYQEYNHEIAGSDEEDDLSKMDMGGRAKGRLHRWDFETEEEWATYNDQKEAMPKAAFQFGVKMQDGRKTRKQNKDQKLTNDLHKINKILARKKGDKDGGHDGGHYDDDMPSGKKQRA

SEQ ID NO: 3699 - protein, 147 aa, Oryza sativa
MSSKKNYYKEKLMRRKEEKKEEPETPRYRDRAKECREDQNLDYEPTELGSFHAVAPPGADLRLADVHKISIEKSKYLGGDLEHTHLVKGLDYALLHKVRSEIEKKPDAEDGKDTQTRSTKEDQAVSFRTATAKSVYKWIIKPQSIIK

SEQ ID NO: 3700 - protein, 570 aa, Triticum aestivum
MSSTQKKKSNYKEKMARRKEENKKEEPETPRYRDRAKERREDQNPDYEPTELGSFHAVAPPGADLRLEDAQKISIEKSKYLGGDLEHTHLVKGLDFALLNKVRSEIDKKPDAEDGKDAKARETKEDRAVSFRTAIAKSVYQWTVKQQQSMIKANDMFLPGRMAFIYNMEDGLNSDIPTTLHRSKADCPVPEEMVTVSVDGSVLDRIAKIMSYLRLGSSGKVLKKKKKERDTKGKNNLAGGVYNEVVRPAQSDGSVQKHQSEKDMPPPPPPPRKSNFSEKEKHSVPVARADDDDIFIGDGVDYTVPNKEMSQSPISEDMDESPRIHQNQSNLNEPVYGPIQPSEPAQAWQQPMDGYDAMQAQMAAAGYQGEWSGYQYAEQQLAYPEQYMQQGTVGYDVLVDPNISQDPRLMTQADKDKGLGSVFKRDDDRLKQLREKDAREKDPNFISDSYSECYPGYQGYNQEIAGSDDEDDLSKMDMGGRAKGRLHRWDFETEEEWAKYNDQKEAMPKAAFQFGVKMQDGRKTRKQNKDQKLSNDLNKINKILARKKGDKDGGEGHYDDDLPSGKKQRA

SEQ ID NO: 3701 - protein, 572 aa, Brachypodium distachyon
MSTTATKKKSNYKEKMARRKEENKKEEPETPRYRDRAKERREDQNPDYEPTELGSFHAVAPPGAPGADLRLADAQKISIEKSKYLGGDLEHTHLVKGLDFALLNKVRSEIDKKPDAEDGKDAKARETKEDRAISFRTAIAKSVYQSIVKSQSTPKANEMFLPGRMAFIYNMEDGLITNDIPTTLHRSKADCPVPEEMVTVSVDGSVLDRIAKIMSYLRLGSSGKVLKKKKKERDAKGKNNLAGSDYNEGVRPPQTNGSAPKHHLDKEMLPPPPPRKSNFKEKEKQPAPIARADDDDIFVGDGVDYTIPNKELSHSPISEDMDESPHNHQNQSHLTEPVYGPIQPSEPAQAWQQVGGYDAIQAQMAAAGYQGEWPGYQYAEQQLAYPEQYMQQGALGYDVLADPDIPQDPRLMTQADKDKGLGSVFKRDDDRLKQLREKDAREKDPNFISDSYSECYPGYQGYNQEIAGSDDEDDLSKMDMGGRAKGRLHRWDFETEEEWAKYNDQKEAMPKAAFQFGVKMQDGRKTRKQNKDQKLNNDLHKINKILARKKGDKDGGEGHYDDDLPSVKKQRA

SEQ ID NO: 3702 - protein, 571 aa, Secale cereale
MSSTQKKKSNYKEKMARRKEESKKEEPETPRYRDRAKERREDQNPDYEPTELGSFHAVAPPGADLRLEDAQKISIEKSKYLGGDLEHTHLVKGLDFALLNKVRSEIDKKPDAEDGKDAKTRETKEDRAVSFRTAIAKSVYQWTVKQQQSMMKANDMFLPGRMAFIYNMEDGLNSDIPTTLHRSKADCPVPEEMVTVSVDGSVLDRIAKIMSYLRLGSSGKVLKKKKKERDTKGKNNLAGGVYNEVVRPAQSDGSVQKHQSEKDMPPPPPPPPRKSNFSEKEKHSVPVARTDDDDIFIGDGVDYTVPNKEMSQSPISEDMDESPRIHQNQSNLNEPVYGPIQPSEPAQAWQQPMDGYDAIQAQMAAAGYQGEWSGYQYAEQQLPYPEQYMQQGTLGYDVLVDPNISQDPRLMTQADKDKGLGSVFKRDDDRLKQLREKDAREKDPNFISDSYSECYPGYQGYNQEIAGSDDEDDLSKMDMGGRAKGRLHRWDFETEEEWAKYNDQKEAMPKAAFQFGVKMQDGRKTRKQNKDQKLSNDLNKINKILARKKGDKDGGEGHYDDDIPSGKKQRA

SEQ ID NO: 3703 - protein, 59 aa, Saccharum officinarum
MAPVSEAASYLELLQGGSIASSLGAVYNAPWDGYRSARGRVSETDSDDDDDDYDCAPAA

SEQ ID NO: 3704 - protein, 57 aa, Zea mays
MAPVSSEAASYLVLIKGGSIAASSRAVYPWDGCSARGRMTETDSDDDDDDYDCAPAA

SEQ ID NO: 3705 - protein, 61 aa, Zea mays
MAPAVVSVAAASYYLVQGGSITSSSGAVYAAPCDGCCSARGRMAETDGDDDDDDYDCAPAA

SEQ ID NO: 3706 - protein, 55 aa, Panicum virgatum
MAPVLSAEAASYLVLGGSIASSWGAVYAAPCSARGRMAETDSDDDDDDYDCAPAA

SEQ ID NO: 3707 - protein, 61 aa, Panicum virgatum
MKLVCDMTYCALWPRTSRLALYDYYCPNRAPSPLHANNNPIGLGVYGFLHMYSRLAYDRGS

SEQ ID NO: 3708 - protein, 73 aa, Setaria italica
MGGAAREEGCRRQTTTTMTTMTALLLPDKETPSDETGVCYAIWCAWWLTITDITPELECRRCCLLIIRSVLGS

SEQ ID NO: 3709 - protein, 751 aa, Panicum virgatum
MRRLLLLVLAAAPAAAAGGEMGYTHCACDGEGGGGGFWSLDNIFKWQKVSDLLIAAAYFSIPLELLYFVAGLRHLLPFRWVLVQFGAFIVLCGLTHLLAAFTYEPHPFMVVLLLTAAKFLTALVSFLTAITLLTLIPQLLRVKVRESLLWIKARELDREVVLMKRQEEASWHVRMLTQEIRRSLDRHTVLYTTLIELSRVLALNNCAVWMPSEDKSGMCLTHELRRGSDGEAVVSADDKDVLEVKSSDGVKLLPPESVLGSASGGGKEGTGTVAAIRMPMLKVADFKGGTPEVIQTSYAVLVLVPPSDRNWAPHELEIVEVVADQVAVALSHASLLEESQAMRDRLAEQNRELLQARRDALMANEARDAFQRVMSQGMRRPIHSILGLVSVVQEEGLTPEQKLVIDTMARTATVVSTLIKDVMEMSAVNQERFPLETRPFHLQSMIRDAACVARCLCDFRGFGFAVHIENALPDLVIGDERRIFHVLLHMVGNLIGRIDAGNVTFRVRADDETMEDQRWDPWRPSYSGGHSSVKFVIGVKQQQSADSSSSLAQFLRKPSAEGFDLRLSFSMCRKLVQMMQGNIWAILDGQGLPESMTLVLRFQLQPSLSGSSLGGSFDLQYPSPSNQIAGLKVLLIDDDEINLVVARKLLEKIGCTVSSLPSGSGFMNSVGPTSTSFQLVVVNLEMARVNPLDVASRIRQYRSAHWPLVMAMTSEQNVWEKCAQSGINGVLKKPLVLQEVKDELTRILQNT

SEQ ID NO: 3710 - protein, 750 aa, Panicum virgatum
MRRLLLLVLAAAPAAAGGEMGYTHCACDGEGGGGGFWSLDNIFKWQKVSDLLIAAAYFSIPLELLYFVAGLRHLLPFRWVLVQFGAFIVLCGLTHLLAAFTYEPHPFMVVLLLTAAKFLTALVSFLTAITLLTLIPQLLRVKVRESLLWIKARELDREVVLMKRQEEASWHVRMLTQEIRRSLDRHTVLYTTLIELSRVLALNNCAVWMPSEDKTGMCLTHELRQGSDGEGVVSADDKDILEVKSSDGVKLLPPESVLGSASGGGKEGTGTVAAIRMPMLKVADFKGGTPEVIQTSYAVLVLVPPSDRNWAPHELEIVEVVADQVAVALSHASLLEESQAMRDRLAEQNRELLQARRDALMANEARDAFQRVMSQGMRRPIHSILGLVSVVQEEGLTPEQKLVVDTMARTATVVSTLIKDVMEMSAVNQERFPLETRPFHLHSMIRDAACVSRCLCDFRGFGFAVHIENALPDLVIGDERRIFHVLLHMVGNLIGRIDAGTVTFRVRADDETMEDQRWDPWRPSYSGGHSSVKFVIGVKQQQSADSSKSLAQFLRKPSTEGFDLRLSFSMCRKLVQMMQGNIWAILDGQGLPESMTLVLRFQLQPSLSGSSLGGSFDLQYPSPSNQIAGLKVLLIDDDEINLVVARKLLEKLGCTVSSLPSGSGFMNSVGPTSTSFQLVVVNLEMARVNPLDVASRIRQYRSAHWPLVMAMTSEQNVWEKCAQSGINGVLKRPLVLQEVKDELTRILQNT

SEQ ID NO: 3711 - protein, 753 aa, Setaria italica
MRRLLLLVLAAAPAAATAGEMGYTHCACDGGGGGGGGGFWSLDNIFKWQKVSDLLIAAAYFSIPLELLYFVAGLRHLLPFRWVLVQFGAFIVLCGLTHLLAAFTYEPHPFMVVLLLTAAKFLTALVSFLTAITLLTLIPQLLRVKVRESLLWIKAHELDREVVLMKRQEEASWHVRMLTQEIRRSLDRHTVLYTTLIELSRVLALNNCAVWMPSEDKSGMCLTHELRRGSDGEAIVSADDADVLKVKGSDGVKLLPPESVLGSASGGGKEGTGTVAAIRMPMLKVADFKGGTPEVIQTSYAVLVLVPPSDRNWAPHELEIVEVVADQVAVALSHASLLEESQAMRDRLAEQNRELLQARRDTLMANEARDAFQRVMSQGMRKPIHSILGLVSVVQEEGLTSEQKLVIDTMARTATVVSTLINDVMEMSAVNQERFPLETRPFHLHSMIRDAACVARCLCDFRGFGFTVHVENTLPDLVIGDERRIFHVLLHMVGNLIGRINAGNVTFRVRADDEAMEDQRWDPWRPSYSGGHSSVKFVIGVKRQESADSSSSLAQFLRKPSTEGFDLRLSFSMCRKLVQMMQGNIWAILDGQGLPESMTLVLRFQLQPSLSGSSLRGSFDLQYPSPSSQIAGLKVLLIDDDDINLVVARKLLEKLGCTVSSLPSGSGFMNSVGPTSTLFQLVVVNLEITAVNPLDVASRIRQYRSTQWPLVMTMTSEHNVWEKCAQSGINGVLKKPLVLQEIKDELTRILQNT

SEQ ID NO: 3712 - protein, 754 aa, Zea mays
MRWLLLLAFAAAPAAGEMGYAHCGCDGSGGAGGGSGFWSLDNIFKWQKVSDLLIAAAYFSIPLEILYFVAGLRHLLPFRWVLVQFGAFIVLCGLTHLLAAFTYEPHPFMVVLLLTAAKFLTALVSFLTAITLLTLIPQLLRVKVRESLLWIKARELDREVVLMKRQEEASWHVRMLTQEIRRSLDRHTVLYTTLIELSRVLALDNCAVWMPSEDKSGMCLTHELRRGSDDGEAVVGADDADVLEVKGADGVKLLPPGSVLGSASGGGKEGTGTVAAIRMPMLRVADFKGGTPQVIKASYAVLVLVPPSGRKWAPHELEIVEVVADQVAVALSHASLLEESQAMRDRLAEQNRELLQARRDALMANEARDAFQRVMSQGMRRPIHSVQGLVSVVQEEEGLASEQRLVVDAVARTATVVSTLINDVMEMSAATSQERFPLETRPFRLRSMVRDAACVARCLCDLSGRFGFAVHVENVLPDLVIGDERRIFHVLLHMVGNLIGRVDEGDVTFRVRADDEATEDQRWDPWRPSYSGGHSSVRFVVGVKRQQNAGDSLPRFLRRPRTHDGLDLRLSFSMCRKLVQTMQGNIWAVLDGQGLPESMTLVLRFQLQPSLASSNLLGGSFDQEHYSSLPSNQIAGLKVLLIDDDEINLVVARKLLERLGCTVSSGSGLMDSSSACASFQLVMVNLEMSAIDPLDAASRIRQQYRSSHWPLVMAMTSEQNVWEKCAQSGINGVLKKPLVLLEVKEELERILQNT

SEQ ID NO: 3713 - protein, 750 aa, Brachypodium distachyon
MRVLLLLLLAVAPAAVAATGDDVGYPHCNCGGGGGFWSMENIFKWQKVSDLLIAAAYFSIPLEILYFVAGLRHLLPFRWVLVQFGAFIVLCGLSHLLTAFTYEPHPFMVVLLLTTAKFLTALVSFLTAITLLTLIPQLLRVKVRESLLWIKARELDREVDLMKQQEEASWHVRMLTQEIRKSLDRHTVLYTTLIELSRVLELKNCAVWMPAEDKAAMHLTHELRRGGSDGLVVGVDDADVVEVRRSDGVKLLGPDSVLASASGGGREDTGPVAAIRMPMLKVSDFKGGTPEVIQASYAVLVLVPPSDKNWGAHELEIVEVVADQVAVALSHASLLEESQAMRDRLAEQNRELLQARRDTLMANEARDAFQLVMSQGMRKPIHSILGLVSVVQEDNLMPEQKLVVNTMARTATVVSTLINDVMEMSATNRERFPLETRPFHLHSMIRDAACVARCLCDFRGFGFAVHVENTLPDLVIGDERRIFHVILHMVGNLISRINSGHVTFRVRADDEVMEGSLGQRWDPWRPSYSSGYSSVKFVIGWKSTESVSSAGQFLRKPNGEGFDLRLSFSMCRKLVQMMRGNIWAVLDGQGLPESMTLVLRFQLQPSLTSSSTGGSFERQYTSPSCQLTGLKVLLIDDDDINMVVARKLLEKLGCVVSSLPSGSGFLNSVGPSSGAFQVVMVNLEMTRVNALDVAARVRQYRSGRWPFVMAMTSEQNAWEKCAQSGINGIIRKPVVLREMKEELTRILQST

SEQ ID NO: 3714 - protein, 729 aa, Zea mays
MAASARGSVWEIQPRDVEAAGLAAADAAAFHAALRSAAGSAAASGDAVWAAVAAAGVLRPEHPHALHQLVYYSAYAGWDRAARGPPPYWFPSPTDCKQTNLGRLMEVNGPKLLGSSYRDPISSFNHFYRFSVENQEVYWSMVLKQLAVKFKQEPMSILSTSDRSKKGGTWLQGAVLNIAECCLLPCPSLKRTDDSTAIIWRDEGLDDYPVNRMSLKELRSQVITVAHALDAIFEKGDPIAIDTPMTCNAVIIYLAIILGGFVVVSIADSFAPQEIGSRMGVSKAKAIFTQDFIVRGGKKVPLYSRVIQGTSSKAVVIPAIGDSLGIMLRDGDMSWKDFLSHAAGRSSSYSPVYQSVDALTNILFSSGTTGEPKAIPWTQLSPIRCASDTWAHLDVRPCDIGCWPTNLGWVMGPIIIYSCFLTGATLALYHGSPLGRDFCKFVQDAGVTVLGSVPSLVKSWKAGNCAEGLDWTKIRVLGTTGEASDIDDNLWLTSRASYKPIVECCGGTELASSYIQGSLLRPQAFGAFSGASMSTGFVILDEQGTPYPDDIPCSGEVGLFPLYFGATDRLLNADHDKVYFDGMPIYKGRQLRRHGDIIQRTVGGYYIVQGRADDTMNLGGIKTSSVEIERVCNRADECLLETAAVSIKPSGGGPEHLAILAVLKDRSAQYDVNLLKRKFQTAIQKNLNPLFKVSYVKVVAEFPRTASNKLLRRVLRDQLAQELSNRSKL

SEQ ID NO: 3715 - protein, 731 aa, Setaria italica
MAASARGSVWEIQPGDVGAAGLGAADGGAFLAALRSAAAAAGPGAAGDAVWAAVAAAGVLLPEHPHALHQLVYYSVYAGWDRAARGPPPYWFPSPIDSKQTNLGRLMEANGPKLLKSSYKDPISSFSHFYRFSVENQEVYWSMVLKQLALKFQQEPKAILSTSDRSKKGGTWLQGAVLNIAECCLLPCPSLKRTDDSTAIVWRDEGLDDHPVNRMSLKELRSQVIAVANALDTMFQKGDRIAIDMPMTCNAVIIYLAIVLGGFVVVSIADSFAPQEIGTRMGVSKAKAIFTQDFIIRGGKKVPLYSRVVQGTSSKAVVIPANGDYLGVTLRNGDMSWKDFLSRAAGRSSIYSPAYQSVDAITNILFSSGTTGEPKAIPWAQLSPIRCAADTWAHMDVRPEDIGCWPTNLGWVMGPIILYSCFLNGATLALYHGSPLGRDFCKFVQDAGVTVLGTVPSLVKSWKAANCAKGLDWTKIRVLGTTGEASDIDDNLWLTSRTSYKPIVECCGGTELASSYIQGSLLQPQVFGAFSGASMSTGFVILDEQGTPYPDDVPCAGEVGLFPLYFGATNWLLNADHNKVYFDGMPIYKGRQLRRHGDIIQRTVGGYYIVQGRADDTMNLGGIKTSSVEIERVCNRADEGLLETAAVSVKPAGGGPEHLAILAVLKDRSAQYDVNVLKSKFQRAIQKNLNPLFKVSYVKVVPEFPRTASNKLLRRVLRDQLKQELSNHSKL

SEQ ID NO: 3716 - protein, 731 aa, Panicum virgatum
MAATARGSVWEIQPGDVGAAGLGAADAGAFLAALRSAAATAGPGAAGDAVWAAVAAAGVLRPEHPHALHQLVYYSVYAGWDRATRGPPPYWFPSPIDSRQTNLGRLMEANGPKLLGPAYKDPITSFNLFYKFSVENQEVYWSMVLKQLAVKFQKEPKSILSTSDTSKKGGTWLQGAVLNIAECCLLPCPSLNRTDDSTAIVWRDEGHDDYPVNRMSLKELRSQVITAANALDTMFHKGDPIAIDMPMTCNAVIIYLAIILGGFVVVSIADSFAPLEIGTRMGVSKAKAIFTQDFIIRGGKKVPLYSRVVQGSSSKAVVIPATGDYLGVTLRNGDMSWKDFLCRASGRSPIYSPVYQSVDALTNILFSSGTTGEPKAIPWSQLSPIRCAADTWAHMDVRPQDIFCWPTNLGWVMGPIALYACLLNGATLALYHGSPLGRDFCKFVQDAGVTLLGSVPSLVKSWKAGNCVKGLDWTKIRVLGTTGESSDIDDNLWLTSHTSYKPIVECCGGTELASSYIQGSLLQPQAFGAFSGASMSTGFVILDEQGTPYPDDVPCAGEVGLFPLHFGATNWLLNADHDKVYFGGMPIYNGRQLRRHGDIIQRTVGGYYIVQGRADDTMNLGGIKTSSVEIERVCNRADERLLETAAVSIKPAGGGPEHLAILAVLKDRSAQYDVNLLKSKFQKAIQKNLNPLFKVSHVKVVPEFPRTASNKLLRRVLRDQLKQELSNHSKL

SEQ ID NO: 3717 - protein, 730 aa, Oryza sativa
MAAAAAARGSVWEIQQRDVEAAGLADADAGAFVAALRSAAAVATGGPDAAWEAVAAGVLRPEHPHALHQLVYYSVYAGWDRAARGPPPYWFPSQIDTKQTNLGRLMEAHGPRLLGSSYKDPVSSFHLFHKFSVEHQEVYWSMVLKEISIKFQQEPKSILDTSDKSRKGGTWLQGAVLNIAECCLLPWPSQNRTDDSTAIVWRDEGLDNHPVNRMSLKELHNQVITVATALDTMFQKGDRIAIDMPMTCNAVIIYLAIVLGGFVVVSIADSFAPQEIGTRMSVSKAKAIFTQDFIIRGGKKVPLYSRVVQGTSSKAVVIPATGGFLGVSLRNGDMSWKDFLSCAAGRSSIYPTVYQPSDALTNILFSSGTTGEPKAIPWSQLSPIRCTCDTWAHLDIQPQDIFCWPTNLGWVMGPILLYSCFLSGATLALYHGSPLGRGFCKFVQDAGVTILGSVPSLVKSWKAGNFTEGLHWTKIRVLSTTGEASDIDDDLWLSSRASYKPIIECCGGTELASSYIQGSLLRSQAFGAFSGASMSTGFVILDEQGTPYPDDVPCAGEVGLFPLYFGATDRLLNADNNKVYFDGMPIYNGRQLRRHGDIIQRTVGGYYIVQGRADDTMNLGGIKTSSVEIERICNRADEALLETAAVSIKPAGGGPEQLAILAVLKDRSPPCDANVLKSKFQRAIQKNLNPLFKVSYVKIVPEFPRTASNKLLRRVLRDQLSKELSNRSKL

SEQ ID NO: 3718 - protein, 730 aa, Brachypodium distachyon
MAATARGSAREIRAADVEVAGLAAAEAGAFLAALRSAAASSPSSDAAEVWAAVVAAGVLRPEHPHALHQLVYYSVYAGWDRAARGPPPYWFPSPIDCKRTNLGRMMEQNGPKLLGSSYKDPISSFDLFHKFSVENQEVYWRMVLKELSVKFLREPKSILDASDKSKKGGTWFQGAVLNIAECCLLPWPSQNRTDDSTAIVWRDEGLDDYPVNRMSLKELRTQVMTVAHALDTMFQKGDRIAIDMPMTCNAVIIYLAIILGGFVVVSIADSFAPQEIGTRMRVSNAKAIFTQDFIIRGGKQFPLYSRVMEGTSSKAIVIPATGDCLGVTPRTGDMSWKDFLSRAAGRSSIYSPVYQPSDALINILFSSGTTGEPKAIPWTQLCPIRCGADTWAHLDVRPQDIGCWPTNLGWVMGPILLFSCFLSGATLALYHGSPLGHGFCKFVQDARVNMLGTVPSLVKAWKAGNLTKGIDWTKIRVLATTGEASDIDDNLWLSSRACYKPIVECCGGTELASSYIQGSLLQPQAFGAFSGKSMSTGFVILDEQGHPYPDDQPCAGEVGLFPLYFGATDRLLNGDHDKVYFDGMPIYKGRQLRRHGDIIQRTVGGYYIVQGRADDTMNLGGIKTSSVEIERVCNRADEGLLETAAVSIKPTGGGPEQLAILAVLKDRSASCDAHLLKSKFQRAIQKNLNPLFKVSYVKVVPEFPRTASNKLLRRVLRDQLKLELVNRSKL

SEQ ID NO: 3719 - protein, 729 aa, Secale cereale
MAATARGGMGEIRAADVEAAGLAAADAGAFLAALRSATGKYGGDAAAAWAAVVAAGVLRPDHPHALHQLVYYSVYAGWDRAKRGPPPYWFPSPIDCKQTNLGRVMEENGPKLLGASYKDPISSFGPFHKFSVHNQEAYWKIVLKELSIKFVREPMSILDASDKSKKGGSWFPGAVLNIAECCLLPWPSQNKTDDSTAIVWRDEGFDDYPVNRMSLKELRTQVMTVANALDTMFQKGDRIAIDMPMTCNAVIVYLAIILGGFVVVGIADSFAPQEIATRMRVAKAKAIFTQDFIIRGGKKFPLYSRVMEGTSSKAIVIPATGDCLGVALRKGDMSWKDFLSRAAGRSSIYSPVYQSADALINILFSSGTTGEPKAIPWTQLCPIRCGADTWAHLDVRPKDIGLWPTNLGWVMGPIQLFSCFLNGATLALYHGSPLGRAFCKFVQDARVSVLGSVPSLVKSWKAGNLTEGLDWTKIRVLATTGEASDIDDNLWLSSRTCYKPIVECCGGTELASSYIQGSLLQPQAFGAFSGASMSTGFVILDEQGNPYPDDLPCSGEVGLFPLYFGATNRLLNADHDKVYFDGMPIYRGRQLRRHGDIIQRTVGGYYIVQGRADDTMNLGGIKTSSVEIERVCNGADEGLLETAAVSIKPSGGGPEQLAILAVLKDRSTSYDANILKSKFQRAIQRNLNPLFRVSYVKVVPEFPRTASNKLLRRVLRDQLKQELMNRSKL

SEQ ID NO: 3720 - protein, 625 aa, Panicum virgatum
MEANGPKLLGPAYKDPITSFNLFYKFSVENQEVYWSMVLKQLAVKFQKEPKSILSTSDRSKKGGTWLQGAVLNIAECCLLPCPSLNRTDDSTAIVWRDEGHDDYPVNRMSLKELRSQVITVANALDTMFHKGDPIAIDMPMTCNAVIIYLAIILGGFVVVSIADSFAPQEIGTRMGVSKAKAIFTQDFIIRGGKKVPLYSRVVQGSSSKAVVIPATGDYLGVTLRNGDMSWKDFLCRASGRSSIYSPVYQSVDALTNILFSSGTTGDPKAIPWTQLSPIRCAADTWAHIDVRPQDIFCWPTNLGWVMGPIVLYSCFLNGATLALYHGSPLGRDFCKFVQDAGVTLLGSVPSLVKSWKAGNCVKGLDWTKIRVLGTTGEASDIDDNLWLTSHTSYKPIVECCGGTELASSYIQGSLLQPQSFGAFSGASMSTGFVILDEQGTPYPDDVPCAGEVGLFPLYFGATNWLLNADHDKVYFDGMPIYNGRQLRRHGDIIQRTVGGYYIVQGRADDTMNLGGIKTSSVEIERVCNRADERLLETAAVSIKPAGGGPEHLAILAVLKDRSAQYDVNLLKSKFQKAIQKNLNPLFKVSYVKVVPEFPRTASNKLLRRVLRDQLKQELSNHSKL

SEQ ID NO: 3721 - protein, 200 aa, Saccharum officinarum
MLAVFDPAVAPSPEGLRQPGAAGGDSAAGLADRFREARPDAVTVNLGGSGAMAYSSSNQSPLLPRLFGAVDDIFCMFQGTIVNVAVLKQQYGLSKGANEVNIIIEAYRTLRDRGPYPADQVVRDISGKFAFVLYDCSTKSVFMAADSDGNVPFYWGADTDGRLVVSDDAELVKKACGKSSAPVPKASSSDVRRVKSTSTP

SEQ ID NO: 3722 - protein, 247 aa, Zea mays
MLAVFDRAVAPSPEGLRQPGAAGGGCAAGLADRFREARPDAVTVNLGGSGALAYSSSNQNPLLPRLFGAVDGVFCMFQGTIANVAVLKQQYGLSKGANEVSIIIEAYRTLRDRGPYPADQVVRDISGKFAFVLYDCSTKSVFMAADTDGNVPFYWGVDTDGRLVVSDDAELVKSACGKSCAPFPKGFFFTTSGGLRSYEHPMHEVKPVPRVDSKGEVCGTTYTVDASARKETTIPRVGSAADWSSQY

SEQ ID NO: 3723 - protein, 247 aa, Panicum virgatum
MLAVFDRAVAPSPEGLRQPGAAGDGSAAGLADRFREARPEAVTVNLSGSGAMAYSSHGQSPLLPRLFGAVDDIFCMFQGTIENVAVLKQQYGLSKGANEVNIIIEAYRTLRDRGPYPADQVVRDISGKFAFVLYDCSTKSVFMAADADGNVPFYWGVDSDGRLVVSDDGEIVKKACGKSSSLFPKGFFFTTSGGLKSYEHPMNEVKPVPRVDSKGEVCGTTYTVDAKAKKDASIPRVGSAADWSSQY

SEQ ID NO: 3724 - protein, 247 aa, Setaria italica
MLAVFDREVAPSPEGLRQPGAAGDGSAAGLAGRFREARPDAVTVNLGGSGAMAYSSHGQSPLLPRLFGAVDGMFCMFQGTIENVAVLKQQYGLSKGANEVNIVIEAYRTLRDRGPYPADQVVRDISGKFAFVLYDCSTKSVFMAADADGNVPFYWGVDSDGRLVVSDDDEMVKKACGKSSAPFPKGFFFTTSGGLQSYEHPMNEVKPVPRVDSKGEVCGTTYTVDAKAKKDTSIPRVGSAADWSAQY

SEQ ID NO: 3725 - protein, 247 aa, Cenchrus ciliaris
MLAVFDQAVAPSPEGLRQPGAAGEGSAAGLADRFREARPDAVTVNLGGSGAMAYSSHGQSPLLPRLFGAVDDIFCLFQGTIENVAVLKQQYGLSKGANEVNIITEAYRTLRDRGPYPADQVVRDINGKFAFVLYDSSTKSVFMAADADGNVPFYWGVDSDGRLVVSDDDEMVKKACGKSSAPFPKGFFFTTSGGLQSYEHPMNEVKPVPRVNSKGEVCGTTYTVDAEAKKDTSIPRVGSAADWSSQY

SEQ ID NO: 3726 - protein, 247 aa, Panicum virgatum
MLAVFDQAVAPSPEGLRQPGAAEDGSAAGLADRFREARPEAVTVNLGGFGAMAYSSHGQSPLLPRLFGAVDDIFCMFQGTIENVAVLKQQYGLSKGANEVNIIIEAYRTLRDRGPYPADQVMRDISGKFAFVLYDCSTKSVFIAADADGNVPFYWGVDSDGRLVVSDDGEIVKKACGKSSAPFPKGFFFTTSGGLKSYEHPMNEVKPVPRVDSKGEVCGTTYTVDAKAKKDASIPRVGSAADWSSQY

SEQ ID NO: 3727 - protein, 196 aa, Panicum virgatum
MAYSSHGQSPLLPRLFGAVDDIFCMFQGTIENVAVLKQQYGLSKGANEVNIIIEAYRTLRDRGPYPADQVMRDISGKFAFVLYDCSTKSVFIAADADGNVPFYWGVDSDGRLVVSDDGEIVKKACGKSSAPFPKGFFFTTSGGLKSYEHPMNEVKPVPRVDSKGEVCGTTYTVDAKAKKDASIPRVGSAADWSSQY

SEQ ID NO: 3728 - protein, 248 aa, Pennisetum glaucum
MLAVFDQAVAPSPEGLRQPGAAGEVSAAKLADRFMEARPDAVTVNLGSSGAMAYSSNGQSPLLPRLFGAVDDIFCLFQGTIENVAVLKQQYGLSKGANEVNIVIEAYRTLRDRGPYPADQVVRDINGKFAFVLYDCSTKSVFMAADADGNIPFYWGVDSDGRLVVSDDDETVKKACGKSSAPFPKGFFFTTSGGLRSYEHPMNEVKPVPRVNSKGEVCGTTYTVDAKAKKDAGSIPRVGSAADWSSQY

SEQ ID NO: 3729 - protein, 249 aa, Oryza sativa
MLAVFDRAVAPSPEGLRHPGAAGDGAAGLAERFRDARPGAVTVALGPGGANSLAYSSHGQSPLLPRLFAATDEIFCLFQGTIENIAVLKQQYGLHNKGSTEINIIIEAYRTLRDRGPYPADQVVRDINGKFAFVLYDCSNNSVFMATDADGSVPFYWGVDPDSRLVVSDDDEIVNKACGKSSAPFPKGFFFTTSGGLQSYEHPMNEVKPVPRLDSKGEVCGTTYTVDAKAKKDSSIPRVGSAADWSSQY

SEQ ID NO: 3730 - protein, 170 aa, Zea mays
MSRGSKLRWLWRAPARALGRARDLYVRGLTGCARHVPSDAAFGYPVFVPAPLSRSHSAVGWGAGSSEADEDLRELVRAASQRRVEQRRAELQAVARSQSMAASLSMARIDEDAPCDFGAPGALCPRSQSCVGDAAGRRPPPPRPREGGGLALTESELLSGRRRRWHSVCE

SEQ ID NO: 3731 - protein, 645 aa, Zea mays
MEVEALEKKGHAAFAKAMKSFGSSERYKRSTSGRYFEDMYATDALRSSDKTIVLPMPEVVKAKVKCDITKEAQPGRGAQSTLRKEILQLEKHLKDQQAVRGALEKALGPNAGPVSLSPENPMPQAANELIREIATLELEVKNMEQYLLTLYRKAFEQQQAPAFSPPDRREASKPSVSSRSGQLRETPMATKSSCKSRGDAALRSSYPPAHKKLNDPLADCCTSARFDRVVDSDVLRCQSALSYRGVCSSRILPSEDDSLARALRSCHSQPFSFVEEGDTGASGMISLAEYLGTNVADHIPETPNNLSEEMVRCMAGIYCRLADPPLVHHGSSSSPSSSFSSTSAISPQYVGDMWSPKYRREATLDSRLINPFHVDGLKEFSGPYNTMVEVPMISRDSRRLKEAEDLLQTYKLILYRLEAVDLRRMTDEEKIAFWVNIHNALLMHAYLKNGVPQNNLKKTSLLVKAACKIAGRNINAAVIQSIVLGCNTHCPGQWLRTLLYPRIKSKVSKAGHEWRAFAVAQPEPLLRFALCSGSHSDPAVRVYTPKRLFHQLESAKEEFIRATAGVWKEQKLLLPKLVEAYAKDVKLSPQGLVDMVQRYLPESMRMAVQRCQHGGRSSGKVVEWVSYNPAFRYLLARDLAFPHLS

SEQ ID NO: 3732 - protein, 638 aa, Panicum virgatum
MEVEAPETKGHRAFAKPLKPFSSSERHKQSKSYFEEIYGADALRSSDKTIVLPKPGAVKAKVKSDINKDVRPGRGAQSTLRKEILQLEKHLKDQQVVRGALEKALGPDAAPVSLSPENPMPKAANELIREIATLELEVKNMEQYLLMLYRKAFEQQAPAFSPPDNREASKPSLSSRSGQLWEMPMAMKSFKSREDTALRSSYPLPHKKWNDPLTTSVRPDRAVDSDVLRCQSALSYRGVCSSRIQPSDDDSLARALRSCHSQPFSFLEEGETGASGMISLAEYLGTNVADHIPETPNNLSEEMVRCMAGIYCRLADPPLVHHGSSSSPTSSFSSTSAVSPQYVGDMWSPNYKRETTLDSRLINPFHVEGLKEFSGPYNTMVEVPMISHDSRRLKEAEDLLQTYKLILYRLETVDMRRMTNEEKIAFWVNIHNALLMHAYLKNGVPQNNLKKTSLLVKAACKIAGRNINIAVIQSMVLGCNTHCPGQWLRTLLYPRIKSKVTKAGHEWRAFAVAQSEPLLRFALCSGSHSDPAVRVYTPKRLFHQLEAAKEEFIRATAGVWREQKLLLPKLVEAYAKDVKLSPQGLVDMVQRYLPESMRMAVQRCQQGGRSSSKVVEWVPYNPAFRYLLARDLAFPHLS

SEQ ID NO: 3733 - protein, 646 aa, Panicum virgatum
MEVEAPEMKGQRAFAKGPFAKPMKSFSSSERHKRSKSYFEEIYGADVLRSSDKTIVLPKPEAVKAKVKSGINKDVRPGRGAQSTLRKEILQLEKHLKDQQDVRGALEKALGPDAAPVSLSPENPMPKAANELIREIATLELEVKNMEQYLLTLYRKAFEQQAPAFSPPDNREASKPSLSSRSGQLWEMPMAIKSFKSREDTAVRSSYPLPHKKWNDPLTDCCTSVRPDRAVDSDVLRCQSALSYRGVCSSRILPSDDDSLARALRSCHSQPFSFLEEGETGASGMISLAEYLGTNVADHIPETPNNLSEEMVRCMAGIYCRLADPPLVHHGSSSSPTSSFSSTSAVSPQYVGDMWSPNYKRETTLDSRLINPFHVEGLKEFSGPYNTMVEVPMISHDSRRLKEAEDLLQTYKLILYRLETVDLRRMTNEEKLAFWVNIHNALLMHAYLKNGVPQNNLKKTSLLVKADCKIAGRNINVAVIQSMVLGCNTHCPGQWLRTLLYPRIKSKVSKAGHEWRAFAVAQSEPLLRFALCSGSHSDPAVRVYTPKRLFHQLEAAKEEFIRATAGVWREQKLLLPKLVEAYAKDVKLSPQGLVDTVQRYLPESMRMAVQRCQLGGRSSSKVVEWVPYNQAFRYLLARDLAFPHLS

SEQ ID NO: 3734 - protein, 650 aa, Zea mays
MEVEALEKGYTAFAKAVKSFTSSERYKRSESYFEDMYGTDALRSSDKTIVLPMPEAVKAKVKGDISKEAQPGRGAQSTLRKEILELEKHFREQQVVSGALENALGPNAGSVNFSPENPMPKAANELIREIATLELEVKNMEQYLLTLYRKAFEQQAPALSPPDCREASKPSVSSRFGQLRETPVAAKSCKSGGGDAALRTSYPPPAHKKLNDPLADCCTSARSHRAVDSDVLRCQSALSYRGVCSSRVLPSEEDDDSLARALRSCHSQPFSFAEEGEGAGASGGAISLAEYLGTNVADHIPETPNNLSEEMVRCMAGIYCRLADPPLVHHGSSSSPTLSFSSTTSAVSPQYVGDDMWSPSYRRREATTLDSRLINPFHVEGLKEFSGPYNTMVEVPTISRDGRRMKEAEDLLQTYRLVLYRLEAVDLRTMTNEEKIAFWVNVHNALLMHAYLENGVPQNKTSLLAKAACKIAGRSINAAVIQSVVLGCTTHCPGQWLRRTLLYPRTKSKVSKAGHEWRAFAVAQPEPLLRFALCSGSHSDPAVRVYTPKRLFHQLEAAKEEFIRATAGVWKEQKLLLPKLVEAYAKDVRLSPQGLVDMVQRHLPETMRVAVQRCQQGGRASSGKVVVDWVPHNPAFRYLLARDLAFPHLS

SEQ ID NO: 3735 - protein, 642 aa, Brachypodium distachyon
MEVEALEKKGHRAFAKAIKSFNSSERHKRSKSDLENTYGKDALYAADKTCVRPKQDGVKAKVKSDFSKEVQPGRGAQSSLRKEILQLEKHLKDQQGVRGALEKALGPNAVPVNLSHENPMPNAANELIREIATLELEVKNMEQYLLTLYRQAFEQQAPAFSPPDRRGAPKLSVSSRSGQLRETPDAKASCKSRGDSMLRSSYPPPPSHKKWNDPLTDCSTSSCSGRPNDSDVLRCQSALSYRGICSSRISPAEESLARALRSCHSQPFSFLEEGDATAAGVISLAEYLGTNVADHIPETPNNLSEEMVRCMAGVYCKLADPPLVHHGSSSSPTSSFSSTSAISPQFLGDMWSPSYKRETTLDSRLINPFHVEGLKEFSGPYNTMVEVPAICRDSRRLKEVEDLLQTYKLILYRLETVDLKRMTNEEKIAFWVNIHNALMMHAYLRYGVPQNNLKKSSLLVKAACKIAGRNINVAVIQNLVLGCNTHCPGQWLRTLLYPRIKSRVSKVGHEWQAFAVAQTEPLLRFALCSGSHSDPAVRVYTPKRLFHQLEAAKEEFIRATVGVWREQKILLPKLVEAYAKDVKLSSQGLVDMVQRYLPESLRMAMHKCQQQGGRSSKIIEWVPYNLNFRYLLARDLAFPHLN

SEQ ID NO: 3736 - protein, 649 aa, Oryza sativa
MEVEAMEKKGHRAFAKAIKSFGSSERHKRSKSDLEDMCAKDALYASDKTCVQPKPDAVKVKVKSDINAEVQPGRGAQSFLRKEILQLEKHLKDQQVMRGALEKALGPNATAAPVNVSNENPMPKDAKELIREIATLELEVKNMEQYLLTLYRKAFEQQVPTFSPPDHRGAPKPPVPAMAAVSSQPVQLQKSPSVKASRKNNRADAMLRSSYPPPSRRTLNDPVMTDCSTSGCSSRLGESDVLRCQSAVSYRGICSSRISPSEDSLARALRSCHSQPFSFLEEGESTAAGVISLAEYLGTNVADHIPETPNNLSEEMVRCMAGVYCKLADPPLVHHGSSSSPTSSFSSTSAISPQYLGDIWSPNYKRESTLDSRLINPFHVEGLKEFSGPYNTMVEVPLICRDSRRLKEVEDLLQTYKLILYRLETVDLRRMTNEEKIAFWVNIHNAQLMHAYLKYGVPQNNLKKTSLLVKAACKIAGRSINVAVIQSMVLGCNTYCPGQWLRTLLHPRIKSKVGKVGHVWQAFAVAQSEPLLRFALCSGSHSDPAVRVYTPKRLFHQLEAAKEEFIRATVGIWKEQKILLPKLVEAYAKDVKLSSQGLVDMVQRYLPESLRMAMQKCQQSRSSKIIEWVPHNLNFRYLLSRDLAFPHLN

SEQ ID NO: 3737 - protein, 169 aa, Saccharum officinarum
MASSGDEGRVVVDLRSAAESAAADDDAHATPLHEIESLCMRCGENGITRLLLTLIPHFREVVLMAFECPHCGERNNEIQFAGQLQPKGCCYSLVVPLGQSEILNRQVVKSDSATIKIPELDFEIPPEAQRGTLSTVEGIIMRAVDELQALQDERKKVDPQKAEAIDQFY

SEQ ID NO: 3738 - protein, 498 aa, Zea mays
MASSGNEGRVVVDLGSAAESVAADEEAHATPLHEIESLCMRCGENGITRLLLTLIPHFREVVLMAFECPHCGERNNEIQFAGQLQPKGCCYSLEVPLGQSEMLNRQVVKSDSATIKIPELDFEIPPEAQRGTLSTVEGIIMRAVDELQALQDERKKVDPQKAEAIDQFLLKLRSLGSGEAAFTFILDDPAGNSFIENPHAPLLDPLLSVRFYERTREQQAALGFLAEPPKEQPGEAVLPASAVESNSDGLQSVPHGSVGAVAGRRAIAQGNPDEVAAALCRYSAPEEVDTLPSTCGACGTECVTRFFATKIPYFREVIVMATTCDMCGYRNSELKPGGEIPAKGKKITLRVQNAQDLTRDVIKSDSASVKVPELELELSCGTLGGMVTTVEGLIVKICEALERIHGFQLGDSTLEWKKKKWDDFKERLSKLLSLQEAWTLIIDDGLAASFVAPATDSLEDDSQLTIEEYQRSWEQNEELGLNDMDTSSADAAYNTTNT

SEQ ID NO: 3739 - protein, 498 aa, Setaria italica
MASSGDDGRVVVDLRSAAESAAGAGGEEAHATPLHEIESLCMRCGENGTTRLLLTLIPNFREVVLMAFECPHCGERNNEIQFAGQLQPKGCCYRLEVPSGQSEILNRQVVKSDSATIKIPELDFEIPPEAQRGKCSTVEGIIMRAVDELQALQDERKKVDPQKAEAIDQFLLKLRSLGSGEAAFTFILDDPAGNSYIENPHAPSSDPLLSVRFYERTREQQAALGFLAEPEQPGEAVLPVSAVGSNSGGLQAEPHGAVGALAGRRAIAQGNPDEVAAALCRYAAPEEVDVLPSSCGACGAECVTRFFATKIPYFREVIVMATTCDICGYRNSELKPGGEIPAKGKKTTLRVQNVKDLTRDVIKSDSASVKVPELELELTSGTLGGMVTTVEGLIVKICEALERIHGFHLGDSTLEWKKKKWDDFKDRLSKLLSLQEPWTLILDDGLAASFVAPATDSLEDDKQLTIEEYQRSWEQNEELGLNDMDTSSADHAYNTTST

SEQ ID NO: 3740 - protein, 498 aa, Pennisetum glaucum
MASSGDEGRVVVDLRSAAESAAGAGDDEAHATPIQELESLCMRCGENGTTTLLLTLIPNFREVVLMAFECPHCGERNNEIQFAGQLQPKGCCYRLEVPSGQSEILNRQVVKSDSATIKIPELDFEIPPEAQRGKCSTVEGIIMRAVDELQALQDERKKVDPQKAEAIDQFLLKLRSLGSGEAAFTFILDDPAGNSYIENPHAPSSDPLLSVKFYERTREQQAALGFLAEPEQPVEAVLPASAVGSNSGGLQAEPHGAVGALAGRRAIAQGNPDEVAAALCRYAAPEEVDVLPSSCGACGAECVTRFFVTKIPYFREVILMATTCDFCGYRNSELKPGGEIPAKGKKITLRVQNAKDLTRDVIKSDSASVKVPELELELTSGTLGGMVTTVEGLIVKICEALERIHGFQLGDSTLEWKKKKWEDFKDRLSKLLSLQEPWTLILDDGLAASFVAPATDTLEDDKQLTTEEYQRSWDQNEELGLNDIDTSSADQAYNTTNA

SEQ ID NO: 3741 - protein, 496 aa, Brachypodium distachyon
MASSGEEGRVVVDLRSAAESAGDEDAHATPLHEIESLCMRCGENGITRILLTLIPHFREVVLMAFECPHCSERNNEVQFAGQLQPKGCCYRLEVPSGKSEILNRQVVKSDSATIKIPELDFEIPPEAQRGTLSTVEGCIMRAVDELQALQDERKKVDPQKAEAIDKFLVKLKSLGSGEVAFTFILDDPSGNSFIENPHAPSSDPLLSLKFYERTSEQQAALGFLAEPTKEPGESSRDASTVEAKSGGLQRMPHGSVGAIAGRRAIAQGNSDEVTAALCRYSAPEEVDTLPSTCGACATECVTRFFATKIPYFREVIVMATTCDVCGYRNSELKPGGEIPAKGKKTTLRVQNAKDLSRDVIKSDSAAVQVPELDLELSSGTLGGMVTTVEGLIVKICEALERVHGFQLGDSTHEWKKKKWDGFTERLSKLLSLQEPWTLIIDDALAASFVAPATDSIEDDHQLTIEEYERSWEQNEELGLNDMDTSSADMAYNTTST

SEQ ID NO: 3742 - protein, 498 aa, Panicum virgatum
MASSGDEGRVVVDLRSAAESVGRAGDEEAHDAPIQEIESLCMRCGKNGTTRVMLTLVPNFREVILMSFECPHCGERNNETQFGGQLQPKGCCYRLKVPSGQREILNRHVVKSDSATIKIPELDFEIPPEAQRGTCSTVEGIIMRAVDGLQALQDERKKVDPQTAEAIDQFCLKLRSFGSGEAAFTFILDDPAGNSFVENPNAPSSDPLLSVRFYERTREQQAALGFLAEPEQPGEGVLPASAVGSNSGGLQSEPHGSVGAAAGRRAIAQGNPDEVAAALCRYSAPEEVDVLPSTCGACGKECVTRFFATKIPYFREVILMATTCDLCGYRNSELKAGGEIPAKGKKITLRVQNAKDLTRDVIKSDSAGVQVPELELELAGGTLGGIVTTVEGLIVKICEALERIRGFQFGDSTLEWEKKKWDDFRNRLSKLLSLQEPWTLILDDGLAASFVAPATDSLEDDKQLTIEEYERSWEQNEELGLNDMDTSSADAAYNTTKT

SEQ ID NO: 3743 - protein, 498 aa, Panicum virgatum
MASSGDEGRVVVDLRSAAESVGRAGDEEAHDAPIQEIESLCMRCGKNGTTRVMLTLVPNFREVILMSFECPHCGERNNETQFGGQLQPKGCCYRLKVPSGQREILNRHIVKSDSATIKIPELDFEIPPEAQRGTCSTVEGIIMRAVDGLQALQDERKKVDPQTAEAIDQFCLKLRSFGSGEAAFTFILDDPAGNSFVENPNAPSSDPLLSVRFYERTREQQAALGFLAEPEQPGEGVLPASAVGSNSGGLQSEPHGSVGAAAGRRAIAQGNPDEVAAALCRYSAPEEVDVLPSTCGACGKECVTRFFATKIPYFREVILMATTCDLCGYRNSELKAGGEIPTKGKKITLRVQNAKDLTRDVIKSDSAGVKVPELELELAGGTLGGIVTTVEGLIVKICEALERIRGFQFGDSTLEWEKKKWDDFRNRLSKLLSLQEPWTLILDDGLAASFVAPATDSLEDDKQLTIEEYERSWEQNEELGLNDMDTSSADAAYNTTKT

SEQ ID NO: 3744 - protein, 494 aa, Triticum aestivum
MANSGDEARVVTDLRSAAESAGGDEALHEIESLCMRCGENGTTRLLLTTIPNFREVVLMAFECPHCNERNNEVQFAGQLQPKGCCYRLEIPQGQNEILNRQVVKSDSATIKIPELDFEIPPEAQRGTLSTVEGIIMRAVEELQALQDERKKADPQKAEAIDQFLIKLRSLGSGEAAFTFVLDDPAGNSFIENPHAPSSDPSLSVSFYERTSEQQAALGFLVDPPTGESGDPSQNASTVEANSVELPKVPHGSVGAVAGRRAIAQGNPDEIAAALCRYTAPEEVDTLPSTCGACGAACVTRFFATKIPYFREVIVMAASCDLCGYRNSELKPGGEIPAKGKKIMLHVQNVKDLSRDVIKSDSAAVKVPELELELSMGTLGGIVTTVEGLIVKICEALERVHGFQLGDSTNEWKKKKWDDFQQRLSKLLSLQEPWTLIIDDALAASFVAPATDLIEDDSQLLIEDYERSWEQNEELGLNDMDTSSADIAYNMTSAE

SEQ ID NO: 3745 - protein, 497 aa, Triticum aestivum
MASSGEERGVVVDIRSAAESAGDDGARDAPLHVVESLCMRCGENGTTRILLTLIPHFREVVLMAFECPHCSERNNEIQFAGQLQPKGCCYTLKVPKGQPEILNRQVVKSDSATIKIPELDFEIPPEAQRGTLSTVEGSIMRAVSELQALQDERKKVDPQKAEAIEQFLVKLRSLGSGEAAFTFILDDASGNSFIENPNAPSSDPLLSLRFYERTYEQQAALGFLAEPTKESGDSSQDASTVEGNSGGPQRIPHGSVGAVAGRRAIAQGNSDEITAALCRYSAPEEVDTLPSTCAACATECVTRFFSTKIPYFREVIVMATSCDACGYRNSELKPGGEIPAKGKKTTLIVRNVKDLSRDVIKSDSAAVSVPELELELSSGTLGGIVTTVEGLIVKICEALERVHGFQLGDSTYEWKKKKWDGFTERLAKLLNLEEPWTLILDDALAASFIAPATDSLEDDKQLTIEEYERSWEQNEELGLNDMDTSSADMAYNTTSTS

SEQ ID NO: 3746 - protein, 109 aa, Secale cereale
MASSGEDRGVVVDIRSAAESAGDEGARDTPLHVVESLCMRCGENGTTRILLTLIPHFREVVLMAFECPHCSERNNEVQFAGQLQPKGCCYTLKVPKGQPEILNRQVVEI

SEQ ID NO: 3747 - protein, 210 aa, Saccharum officinarum
MECVLGVVGRDFAVVAADTSAVQSILVHKTDEDKVMVLDSHKLMGASGEPGDRVQFTEFIQKNLHLYQFRNTIPLSTAAAANFTRGELATALRKNPYMVNIILGGYDKDVGASLYYIDYIATLHKIDKGAFGYGSYFCLSLMDKLYHPDMTVEEAVDLVDKCIKEIRLRLVVAPQNFVIKIVDKDGAREYARRELIGDNAPVDAAITVAA

SEQ ID NO: 3748 - protein, 210 aa, Triticum aestivum
MECVLGLVGRDFAVVAADTSAVQSILVHKTDEDKVMVLDSHKLLGASGEPGDRVQFTEFIQKNLHLYQFRNTIPLSTAAAANFTRGELATALRKNPYMVNIILGGYDKDVGASLYYIDYIATLHKIDKGAFGYGSYFCLSLMDKLYRPDMTVEEAVDLVDKCIKEIRLRLVVAPQNFVIKIVDKDGAREYARRELVGDNAPVDAAITVAA

SEQ ID NO: 3749 - protein, 210 aa, Zea mays
MECVLGLVGRDFAVVAADTSAVQSILVHKTDEDKVMVLDSHKLLGASGEPGDRVQFTEFIQKNLHLYQFRNTIPLSTAAAANFTRGELATALRKNPYMVNVILGGYDKDVGASLYYIDYIATLHKIDKGAFGYGSYFCLSLMDKLYRPDMTVEEAVDLVDKCIKEIRLRLVVAPQNFVIKIVDKDGAREYARRELVGDSAPAEAAATVAA

SEQ ID NO: 3750 - protein, 211 aa, Zea mays
MECVLGVVGRDFALVAADTSAVQSILVHKTDEDKVMVLDSQKLMGASGEPGDRVQFTEFIQKNLHLYQFRNTIPLSTAAAANFTRGELATALRKNPYMVNIILGGYDKDVGASLYYIDYIATLHKIDKGAFGYGSYFCLSLMDKLYHPDMTVEEAVDLVDKCIKEIRLRLVVAPQNFVIKIVDKDGAREYARRELVGDNAPAEAATAVVAA

SEQ ID NO: 3751 - protein, 213 aa, Panicum virgatum
MECVLGVVGRDFAVVAADTSAVQSILVHKTDEDKVMVLDSHKLMGASGEPGDRVQFTEYIQKNLHLYQFRNTTPLSTAATANFTRGELATALRKNPYMVNVILGGYDKDVGASLYYIDYIATLHKIDKGAFGYGSYFCLSLMDKLYHPDMTVEEAVDLVDKCIKEIRLRLVVAPQNFVIKIVDKDGAREYARRELVGDNASASAGAAATTVAA

SEQ ID NO: 3752 - protein, 212 aa, Cenchrus ciliaris
MECVLGVVGRDFAVVAADTSAVQSILVHKTDEDKVMVLDSHKLMGASGEPGDRVQFTEYIQKNLHLYQFRNTIPLSTAATANFTRGELATALRKNPYMVNIILGGYDKDVGASLYYIDYIATLHKIDKGAFGYGSYFCLSLMDKLYHPDMTVEEAVDLVDKCINEIRLRLVVAPQNFVIKIVDKDGARVLARRELVGDSASAGAAAATTVAA

SEQ ID NO: 3753 - protein, 212 aa, Pennisetum glaucum
MECVLGLVGRDFAVVAADTSAVQSILVHKTDEDKVMVLDSHKLMGASGEPGDRVQFTEYIQKNLHLYQFRNTIPLSTAATANFTRGELATALRKNPYMVNVILGGYDKDVGASLYYIDYIATLHKIDKGAFGYGSYFCLSLMDKLYHPDMTVEEAVDLVDKCIKEIRLRLVVAPQNFVIKIVDKDGAREYARRELVGDSASAEAPATTTVAA

SEQ ID NO: 3754 - protein, 212 aa, Setaria italica
MECVLGLVGRDFAVVAADTSAVQSILVHKTDEDKVMVLDSHKLMGASGEPGDRVQFTEYIQKNLHLYQFRNTIPLSTAATANFTRGELATALRKNPYMVNVILGGYDKDVGASLYYIDYIATLHKIDKGAFGYGSYFCLSLMDKLYHPDMTLEEAVDLVDKCIKEIRLRLVVAPQNFVIKVVDKDGARELARRELVGDSASAEAAAATTVAA

SEQ ID NO: 3755 - protein, 215 aa, Panicum virgatum
MECVLGVVGRDFAVVAADTSAVQSILVHKTDEDKVMVLDSHKLMGASGEPGDRVQFTEYIQKNLHLYQFRNTTPLSTAATANFTRGELATALRKNPYMVNVILGGYDKDVGASLYYIDYIATLHKIDKGAFGYGSYFCLSLMDKLYHPDMTVEEAVDLVDKCIKEIRLRLVVAPQNFVIKIVDKDGAREYARRELVGDNTSASASAGAAATTVAA

SEQ ID NO: 3756 - protein, 210 aa, Avena sativa
MECVLGVVGRDFAVVAADTSAVQSILVHKTDEDKIMVLDSHKLMGASGEPGDRVQFTEFIQKNLHLYQFRNNMPLSTAATANFTRGELATALRKNPYSVNILLAGFDEDVGASLYYIDYIATLHKIDKGAFGYGSYFCLSLMDKLYHPDMTVDEAVDLVDKCIKEIRLRLVVAPQNFAIKIVDKNGARFHARREIVGDSPVEAATAPTTA

SEQ ID NO: 3757 - protein, 211 aa, Secale cereale
MECVIGVVGRDFAVVAADTSAVQSILVHKTDEDKIMLLDSHKLMGASGEPGDRVQFTEFIQKNLHLYQFRNNMPLSTAATANFTRGELATALRKNPYSVNIILAGFDKDAGASMYYIDYIATLHKIDKGAFGYGSYFCLSLMDKLYRPDMTVEEAVDLVDKCIKEIRLRLVVAPQNFAIKIVDKDGARDYARREIGGDSPAAASATIAATA

SEQ ID NO: 3758 - protein, 210 aa, Cynodon dactylon
MECVIGVVGRDFAVVAADTSAVQSILVHKTDEDKVMVLDSHKLMGASGEPGDRVQFTEYIQKNLHLYQFRNTIPLSTAATANFTRGELATALRRNPYMVNVILAGYDKDVGASMYYIDYIATLHKIEKGAFGYGSYFCLSLMDKLYHPDMTLDEAVDLVDKCIKEIRLRLVVAPQNFVIKVVDKDGAKEYARREYISDSPPDAAAAATEA

SEQ ID NO: 3759 - protein, 212 aa, Oryza sativa
MECVIGVVGRDFAVVAADTSAVQSILVHKTDEDKVMVLDSHKLMGASGEPGDRVQFTEFIQKNLHLYQFRNNIPLSTAATANFTRGELATALRKNPYYVNVLLAGYDSDVGASLYYIDYIATFHKIEKGAFGYGSYFCLSLMDKLYRPDMSVEEAVDLVDKCIKEIRLRLVVAPQNFIIKIVDKEGAREYARRAYTDSPPEAATSEAATVAA

SEQ ID NO: 3760 - protein, 213 aa, Hordeum vulgare
MECVIGVVGRDFAVVAADTSAVQSILVHKTDEDKIMLLDSHKLMGASGEPGDRVQFTEFIQKNLHLYQFRNNMPLSTAATANFTRGELATALRKNPYSVNIILAGFDKDAGASMYYIDYIATLHKIDKGAFGYGSYFCLSLMDKLYHPDMTVEEAVDLVDKCIKEIRLRLVVAPQNFAIKIVDKDGARDYARREIGGDSPAAATTAATVATTA

SEQ ID NO: 3761 - protein, 213 aa, Triticum aestivum
MECVIGVVGRDFAVVAADTSAVQSILVHKTDEDKIMLLDSHKLMGASGEPGDRVQFTEFIQKNLHLYQFRNNMPLSTAATANFTRGELATALRKNPYSVNIILAGFDKDAGASMYYIDYIATLHKIDKGAFGYGSYFCLSLMDKLYRPDMTVEEAVDLVDKCIKEIRLRLVVAPQNFAIKIVDKDGARDYARREIGGDSPAAATATATIATTA

SEQ ID NO: 3762 - protein, 211 aa, Pseudoroegneria spicata
  misc_feature (14)..(14): Xaa can be any naturally occurring amino acid
  misc_feature (199)..(199): Xaa can be any naturally occurring amino acid
  misc_feature (204)..(204): Xaa can be any naturally occurring amino acid
MECVIGVVGRDFAXVAADTSAVQSILVHKTDEDKIMLLDSHKLMGASGEPGDRVQFTEFIQKNLHLYQFRNNMPLSTAATANFTRGELATALRKNPYSVNIILAGFDKDAGASMYYIDYIATLHKIDKGAFGYGSYFCLSLMDKLYRPDMTVEEAVDLVDKCIKEIRLRLVVAPQNFAIKIVDRDGARDYARREIGGDXPAAAXATIATTA

SEQ ID NO: 3763 - protein, 209 aa, Brachypodium distachyon
MECVIGVVGRDFAVVAADTSAVQSILVHKTDEDKIMLLDSHKLMGASGEPGDRVQFTEFIQKNLHLYQFRNNMPLSTAATANFTRGELATALRKNPYSVNIILAGFDEDVGASMYYIDYIATLHKIDKGAFGYGSYFCLSLMDKLYRPDMTVEEAVDLVDKCIKEIRLRLVVAPQNFAIKIVDKDGARDYGKRESVSGNPSESTTATTA

SEQ ID NO: 3764 - protein, 223 aa, Eragrostis curvula
  misc_feature (133)..(133): Xaa can be any naturally occurring amino acid
  misc_feature (173)..(173): Xaa can be any naturally occurring amino acid
  misc_feature (178)..(178): Xaa can be any naturally occurring amino acid
  misc_feature (182)..(182): Xaa can be any naturally occurring amino acid
  misc_feature (191)..(192): Xaa can be any naturally occurring amino acid
  misc_feature (198)..(198): Xaa can be any naturally occurring amino acid
MECVIGVVGRDFAVVAADTSAVQSILVHKTDEDKVMVLDSHKLMGASGEPGDRVQFTEYIQKNLHLYQFRNTIPLSTAATANFTRGELATALRKNPYMVNVILAGYDNDVGASLYYIDYIATLHKIEKGAFGXGSYFCLSLMDKLYRPDMTKEEAVDLVDKCIKEIRLRLVVXPQNFXIRLXTRMVLRSMXXVNILAXVPQMRHLYLKPEVFAPLVVGLPAAG

SEQ ID NO: 3765 - protein, 631 aa, Zea mays
MVFGGDRAMGAAPGADAASTMRFALHVVRGRWFMFFASILIMAAAGGTYIFAIYSKAIKTSLGYDQQTLNTLSFFKDVGANVGILPGLINEVTPPWVVLACGAGMNLVGYLMIYLAISGRTARPPVWLMCVYIAVGANSQSFANTGSLVTAVKNFPEDRGVVLGLLKGFVGLSGAIFTQLYRAIYGTDNDGTDLVLLMAWLPAAISLVFIPTIRIMPRNTAARGERKAFFLFLYASIVLAVYLLVMNVVELEVIHFPKPAYYVTAVVLLLLIFFPIVIVVKQELKTYLAPPEPATAAATSAAIVTITVNEKTRASSNNVAPESTDHRHQATAAAAANDDADSSPSCFQDVFRPPARGQDYTILQALFSVDMLVLFVATICGIGGTLTAVDNMGQIGQSLGYPQRSITTFVSLVSIWNYAGRVVAGFASEYVLARYKVPRPLALTVVLLLACVGHALIAFGVNNGLYAASVILGFCFGAQWPLLFAIISEVFGLKYYSTLYNFGAVASPVGSYILNVRIAGRMYDREALRQGGQRGKDLTCIGVRCFRESFLIITGVTLLGALVSLLLAWRTRNFYRGDLYGRFREVGMVGATAGGANDRKVHEAEASTSGGASDSDTKDTSSSETVNGSKV

SEQ ID NO: 3766 - protein, 629 aa, Setaria italica
MVFGDRAATGAPGAGAAPASTMRFALHVMRGRWFMFFASILIMAAAGGTYIFGIYSKAVKSSLGYDQQTLNTLSFFKDVGANVGILPGLINEVTPPWVVLACGAGMNLAGYLMIYLAVSGRTARPPVWLMCVYIAVGANSQSFANTGALVTAVKNFPEDRGVVLGLLKGFVGLSGAIFTQLYRAIYGTDNDGAELVLLMAWLPAAISLLFIPTIRIMPRRDAAGQERGRERRAFFLFLYASIVLAIYLLIMNVVELEVIRFPKPAYYVTAAVLLLLIFFPIVIVVKQELKTYLQPPAPAITTSSIVTITVDHEKTHPSSAQVTPPPASDQAAAAGTSPSCFQDVFRPPARGQDYTILQALFSVDMLVLFVATICGIGGTLTAIDNMGQIGQSLGYAQRSITTFVSLVSIWNYAGRVVSGFASEHLLARYKVPRPLALTVVLLLACVGHGLIASGVSNGLYAASVILGFCFGAQWPLLFAIISEVFGLKYYSTLYNFGAVASPVGSYILNVRVAGRMYDREALRQGGRKGRDLTCIGVRCFRESFLIITGVTLLGALVSLVLAWRTREFYRGDLYGRFREVGMVGAAAGGGGGEDKKVREVASSSGGVSDTDTGNKDSTSTSESGNGNKV

SEQ ID NO: 3767 - protein, 320 aa, Panicum virgatum
MVFGDRATGGPGADAAGTMRFARHVVRGRWFMFFASILIMAAAGGTYIFGIYSKAVKTSLGYDQQTLNTLSFFKDVGANVGILPGLINEVTPPWVVLACGAGMNLAGYLMIYLAVSGRTARPPVWLMCVYIAVGRRRQLAVVRQHRRARHRRQELPRGPRRRARPAQGLRRPQRRHLHPDLPRRLRHRQRRRGARAAHGVAPRRHLAALHPHHPHHAAAERRGRAAERGAQGLLPLPLRLHRARRLPPRHERGRAGGDPLPQAGLLRHGHRAPPTHLLPDRHRGQARAQDLPSAAGASGSVLLHRGDHRRGRENARSTGA

SEQ ID NO: 3768 - protein, 615 aa, Panicum virgatum
MVFGERAAGGPGADAAGTMRFARHVVRGRWFMFFASILIMAAAGGTYIFGIYSKAVKTSLGYDQQTLNTLSFFKDVGANVGILPGLINEVTPPWVVLACGAGMNLAGYLMIYLAVSGRTARPPVWLMCVYIAVGANSQSFANTGALVTAVKNFPEDRGVVLGLLKGFVGLSGAIFTQIYRAVYGTDNDGAELVLLMAWLPAAISLLFIPTIRIMPRPIAAAGRASGERRAFFLFLYASIVLAVYLLVMNVVELEVTRFPKPAYYVTVAVLLLLIFFPIVIVVKQELKTYLLQPAPAPAAAIVTITVEDEKTREAAPAADQDQAAADRDSSSPSCFQDVFRPPARGQDYTILQALFSVDMLVLFVATICGIGGTLTAVDNMGQIGQSLGYPQRSVTTFVSLVSIWNYAGRVVSGFASEYVLARYKVPRPLALTAVLLLACVGHALIAFGVSHGLYAASVILGFCFGAQWPLLFAIISEVFGLKYYSTLYNFGAVASPVGSYVLNVRIAGRMYDREALRQGGRRGRDLTCAGVRCFRESFLIITGVTLLGALVSLLLAWRTREFYRGDLYGRFREVGMAAAGGGEDKKVAGGGVSSDTDAKQDTSSSSESSNGNTKV

SEQ ID NO: 3769 - protein, 308 aa, Setaria italica
MVFGDRAATGAPGAGAAPASTMRFALHVMRGRWFMFFASILIMAAAGGTYIFGIYSKAVKSSLGYDQQTLNTLSFFKDVGANVGILPGLINEVTPPWVVLACGAGMNLAGYLMIYLAVSGRTARPPVWLMCVYIAVGANSQSFANTGALVTAVKNFPEDRGVVLGLLKGFVGLSGAIFTQLYRAIYGTDNDGAELVLLMAWLPAAISLLFIPTIRIMPRRDAAGQERGRERRAFFLFLYASIVLAIYLLIMNVVELEVIRFPKPAYYVTAAVLLLLIFFPIVIVVKQELKTYLQPPAPAITTSRPRPR

SEQ ID NO: 3770 - protein, 1259 aa, Zea mays
MEDVRAAAAAEEVISSRGGSVLGKKTILKSDHFPGCQNKRLSPQIDGAPNYRQAGSLRVHGVAMPTMEGIANVLNHIGAHKKGKQTRILWHSLREEPVIYINGRPFVLRDVEKPFSNLEYTGINRERVEQMEFRLKEDILQEASRYGNKILVTDELPSGQMVDQWESVVYDTVKTPLEVYEELQHQGYLVDYERVPITDEKAPKEGDFDNLVRRISQVDIETEIVFNCQMGRGRTTTGMVIATLVYLNRIGASGIPRTGSIGKVFYAGNDVDDYMPSSEEAILRGEYAVIRSLVRVLEGGVEGKRQVDKVIDKCDSMQNLREAIATYRNNILRQPDEMKREASLSFFVEYLERYYFLICFAVYVHSVSSAHQTTLSVEVSFSDWMRARPELYSILRRLLRRDPMGALGYSSSKPPLTKIVESANGRPQDMDVVAAMRNGEVLGRLTVLKSDHCPGSHSLNLPERVEGAPNFREIPGFPVYGVANPTVDGIRAVIQCISTSKGGRPVLWHNMREEPVIYINGKPYVLREVERPCKNMLEYTGIDRDRVERMEARLKEDILREAERYGGAIMVIHETDDGEIFDTWENVDNEAVLTPLEVYKNLVSEGLPIKYARVPITDGKAPKSSDFDTIAFNVTAASKGTAFVFNCQMGRGRTTTGTVIACLLKLRIDHGRPIRIPVCQYDHEDDAIYSTGGDATDHNGHLNSESWKPRTLTKLNSGFGINDILLLRKITRLFDNGIECRQTLDTVIDRCSALQNIRQAVLNYTRVINQQHVEPRVRRVALNRGAEYLERYLKLIAFSAYLGSEAFDGFCGQGQTKISFKGWLQQRPEIQTMKWSIRLRPGRFFTVPHEQKATYPPPQGDVTMETIVKARSGSVLGKGSILKMYFFPGQKRSSSVNFRGAPHVIKVDGYPVYSMATPTIDGASDVLSYLGSKDTTGRNIAQKVVVTDLREEVVVYIKGSPFVLRELDQPVDTLKHVGISGPMVENIETRLKEDILSEVKQLGGRLLLHQEEFNAATNQCSVVGYWEHIDLEDVMTPAEVYSTLRDKGYCIEYKRIPLTREREALAADVDAIQSSIDESARYYLFISHTGYGGVAYAMAITCLGLSADAKFVMEETAETHFVSTSLAKNVSIKTKTDIALKQGDYRDILNLTRVLVHGPKSKEEVDTVIDRCSGAGHLREDIMHYRKALQDCSHDDDDDCDEEHSYLTDMGTKALRRYFFLITFRSYLYSTTSCKTTFTSWMKARPELGHLCDNLKLDK

SEQ ID NO: 3771 - protein, 1260 aa, Setaria italica
MEDVRAAAAAEQVISSRGGSVLGKKTILKSDHFPGCQNKRLSPQIDGAPNYRQAGSLRVHGVAMPTMEGIANVLNHIGAKKKGKQTRILWHSLREEPVIYINGRPFVLRDVEKPFSNLEYTGINRERVEQMEFRLKEDILQEASRYGNKILVTDELPSGQMVDQWESVVSDTVKTPLEVYEELQHQGYLVDYERVPITDEKAPKEGDFDNLVRRISQVDLETEIVFNCQMGRGRTTTGMVIATLVYLNRIGASGIPRTGSIGKVFYAGNDVDDYMPSSEEAILRGEYAVIRSLVRVLEGGVEGKRQVDKVIDKCDSMQNLREAIATYRNSILRQSDEMKREASLSFFVEYLERYYFLICFAVYVHSVSSAHQTTFSVEVSFSDWMRARPELYSILRRLLRRDPMGALGYSSSKPPLTKIVESADGRPQDMDVVAAMRNGEVLGRQTVLKSDHCPGCHNLNLPERVEGAPNFREIPGFPVYGVANPTVDGIRAVIQRISTSKGGRPILWHNMREEPVIYINGKPFVLREVERPCKNMLEYTGIDRERVERMEARLKEDILREAERYGGAIMVIHETDNGEIFDTWENVDNEAVLTPLEVYKHLECEGLQIKYARVPITDGKAPKSSDFDTIALNVASASKDTAFVFNCQMGRGRTTTGTVIACLLKLRIDHGRPIRIPSCQNNHEDANDAAYSTGEDTADYNGHLSSESWKTRTLTKLNSGFGIKDILLLRKITRLFDNGIECRQTLDTVIDRCSALQNIRQAVLKYTKVINQQHVEPRVRRVALNRGAEYLERYLKLIAFSAYLGSEAFDGFCGQGEVKISFKGWLQQRPEIQTMKWSVRLRPGRFFTVPHEQKATYPPPQGDVTMETVVKARNGSVLGKGSILKMYFFPGQKRSSSVNFRGAPHVFKVDGYPVYSMATPTIDGASDVLSYLGSKDTTGRSIAQKVVVTDLREEVVVYIKGTPFVLRELDQPVDTLKHVGISGPMVESIETRLKEDILAEVKQLGGRLLLHQEEFNADTNQCNVVGYWERIDLEDVMTPAEVYGTLRGKGYDINYKRIPLTREREALAADVDAIQSLIDESARYYLFISHTGYGGVAYAMAITCLTLGADAKFVMEETAETHFVSTSLTKNVSIKTSTDIALRQVDYRDILNLIRVLVHGPKSKEEVDAVIDRCSGAGNLREDILQYRKALQDFSHDDDDDDEELSYLTDMGTKALRRYFFLITFRSYLYCATPREATFRSWMKARPELGHLCDNLKLDK

SEQ ID NO: 3772 - protein, 1256 aa, Brachypodium distachyon
MDDVQAVGEQVISSRGGSVLGKKTILKSDHFPGCQNKRLTPHIDGAPNYRQAGSLRVHGVAMPTMKGIVNVLNHIGAQKKGKQTRVLWHSLREEPVIYINGRPFVLRDVERPFSNLEYTGINRERVEQMEFRLKEDILQEASRYGNKILVTDELPNGQMVDQWESVMSDTVKTPLEVYEELQHQGYLVDYERVPITDEKAPKEGDFDNLVRRISQVDIETEIVFNCQMGRGRTTTGMVISTLVYLNRIGASGIPRTSSIGKVFYAVNDVDDFSPSSEEAILRGEYAVIRSLVRVLEGGVEGKRQVDKVIDKCDSMQNLREAIATYRSSTLRQPDEMKREASLSFFVEYLERYYFLICFAVYVHSVSSAHQATSSEVSFSDWMRARPELYSILRRLLRRDPMGALGYSSSKPSLPKIIESADGRPHEMDVVAAMRNGEVLGRQTVLKSDHCPGCQNLNLPERVEGAPNFREIPGFSVYGVANPTVDGIRAVIQRVSTSKGRRPILWHNMREEPVIYINGKPFVLREVERPYKNMLEYTGIGRDRVERMEARLKEDILREAERYDGAIMVIHETDNGEIFDAWENVSTDAVLTPLEVYKRLDSEGLPIKYARVPITDGKAPKSSDFDTIALNVAAACKDAAFVFNCQMGRGRTTTGTVIACLLRLRIDHGRSIRMPTIQDNHEDTNGADYSSGEETIDHNGHLNSESWELQTLTDVHPRFDINDILLLRKITRLFDNGVECRHILDTVIDKCSALQNIRQAVLQYTKVINQQNMEPRVRRVALNRGAEYLERYLKLIAFSAYLGSEAFDGFCGQGETKISFKNWLQQRPEIQTMKWSIRLRPGRFFTVPDEPKATCQPPQGDVTMEAIVKARNGSVLGKGSILKMYFFPGQRRSSSMNFRGAPHVIKVDGYPVYSMATPTVDGARDVLSYLGSKDTTGRSIAQKVVVTDIREEVVVYIKGTPFVLRELDQPVDTLKHVGISGPMVENIEARLKEDILSEVKQLDGRLLLHQEEINTTTNQCSVLGYWEHIDLEDVMTPAEVYSTLRAQGYCIDYKRIPLTREREALAADVDSIQSSIDESARYYLFISHTGYGGVAYAMAITCLGLGADAKFVMEQTAETHFVSTYLTKSVSVKTSTDIALRQGDYRDILNLTRALVHGPKSKEEVDRVIDRCIGAGHLREDILQYRKALRDCSHDDDDDEAWSYLMDMGTKALRRYFFLITFRSYLYCTSLREATFASWMEGRPELGHLCDNLKLDR

SEQ ID NO: 3773 - protein, 1256 aa, Triticum aestivum
MDDVQAVGEQVISSRGGSVLGKKTILKSDHFPGCQNKRLTPHIDGAPNYRQAGSLRVHGVAMPTMEGIVNVLNHIGAQKKGKQTRVLWHSLREEPVIYINGRPFVLRDAERPFSNLEYTGINRERVEQMEFRLKEDILQEASRYGNKILVTDELPNGQMVDQWESVMSDTVKTPLEVYEELQHQGYLVDYERVPITDEKAPKEGDFDNLVHRISQVDMETEIVFNCQMGRGRTTTGMVISTLVYLNRIGASGIPRTSSIGKVFYAGNDVDDYSPSSEEAILRGEYAVIRSLVRVLEGGVEGKRQVDKVIDKCDSMQNLREAIATYRNSTLRQPDEMKREASLSFFVEYLERYYFLICFAVYVHSVSSAHQATSSGVNFSDWMRARPELYSILRRLLRRDPMGALGYSSSKPTLPKIIESADGRPHEMDVVAAMRNGEVLGRQTVLKSDHCPGCHNLNLPERVEGAPNFREIPGFSVYGVANPTVDGIRAVIQRVSTSKGNRPILWHNMREEPVIYIHGKPFVLREVERPYKNMLEYTGIGRDRVERMEARLKEDILREAERYDGAIMVIHETDNGEIFDAWENVNNEAVLTPLEVYKCLDSEGLPIKYARVPITDGKAPKSSDFDTVAFNVAAACKDAALVFNCQMGRGRTTTGTVIACLLRLRINHGRPIGMPAIQNNHEDTTDADYSSGEETMDHNGHLNSESWKPHTLTELHPRFDINDILLLRKITRLFDNGIECRQILDTVIDKCSALQNIRQAVLQYTKVINQQNMEPRVRRVALNRGAEYLERYLKLIAFSAYLGSEAFDGFCGQGETKISFKNWLQQRPEIQTMKWSIRLRPGRFFTVPDEHKATCQPLQSDVTMEAIVKARNGSVLGKGSILKMYFFPGQRRSSSMNFRGTPHVIKVDGYPVYSMATPTVDGAREVLSYLGCKDTTGRDIIQKVVITDLREEVVVYIKGTPFVLRELDQPVDTLKHVGISGPMVENIEARLKEDILSEVKQLEGRLLLHQEEFNTATNQCSVLGYWEHIDLEDVMTPAEVYSTLRDQGYCIDYKRIPLTREREALAADVDSIQSSINESSRYYLFISHTGYGGVAYAMAITCLRLGADAKFVMEQTAETHFVSSSLTKSVSVKTFTDIALRQGDYRDILNLTRALIHGPKSKEEVDKVIDRCVGAGDLREDILQYRKALRDCSHDDDDDEARSYLMDMGTKALRRYFFLITFRSYVHCTSLHEVTFASWMEARPELGHLCDNLKLDR

SEQ ID NO: 3774 - protein, 1256 aa, Oryza sativa
MEAVEEQVAPEQVISTRGGSVLGKKTILKSDHFPGCQNKRLSPQIDGAPNYRQAGSLRVHGVAMPTMKGIVNVLNHIGAQKKGKQTQVLWHSLREEPVIYINGRPFVLRDVERPFSNLEYTGINRERVEQMEFRLKEDILQEASRYGNKILVTDELPNGQMVDQWESVVTDTVKTPLEVYEELQHQGYLVDYERVPITDEKAPKEGDFDNLVRRISQVDIETEIIFNCQMGRGRTTTGMVIATLIYLNRIGSSGIPRTSSIGKVFHSGNDVDDYMPSSEEAILRGEYSVIRSLVRVLEGGVEGKRQVDKVIDKCDTMQNLREAIATYRNSILRQPDEMKREASLSFFVEYLERYYFLICFAVYVHSVCSAQQSNFSEEVSFSDWMRARPELYSILRRLLRRDPMGALGYSSSKPSLAKIVEYADGRPHEMDIVAAMRNGEVLGRQTVLKSDHCPGCHNLHLPERVEGAPNFREIPEFPVYGVANPTVDGIRAVIQRISTSKGGRPILWHNMREEPVIYINGKPFVLREVERPYKNMLEYTGIDRDRVERMEARLKEDILREAERYSGAIMVIHETDNGEIFDAWENVNNEAVLTPLEVYKLLESEGLPIKYARVPITDGKAPKSSDFDTITLNVAAAHKDTAFVFNCQMGRGRTTTGTVIACLLRLRIDHGRPIRLPACEYNHEDPNELGYSSGEETTDHNGHLNSSSPRPHTVTEQHPRFGIDDILVLRKITRLFDNGIECRQTLDNVIDKCSALQNIRQAVLQYTKVINQQHVEQRVKRVALNRGAEYLERYLKLVAFSAYLWSEAFDGFCGQGEAKMSFKAWIHQRPEIQSMKWSIRLRPGRFFTVNDESKASFQPSQGDVMMEAIVKARNGSVLGKGSILKMYFFPGQKRSSTINFCGAPQVFKVDGYPVYSMATPTVDGAKEVLSYLGSKDTGRSIPQKVVVTDLREEVVVYIKGTPFVLRELDQPVDTLKHVGISGPMVENIEARLKEDILSEVKQQGGRLLLHQEEFNSSTGQSSVVGFWEHIGTEDVMTPAEVYSVLRNQGYCIDYKRIPLTREREALASDVDAIQSSVDENARYYLFISHTGYGGVAYAMAITCLGLGADEKFIMEQTAETHFISTSLTKSVSIKTSADIALKQGDYRDILNLTRVLVHGPKCKEEVDTVIDRCVGAGHLREDIMHYRKALQDCSLDDDETWSYLMDMGTKALRRYFFLITFRSYLYCSSLREPTFASWMEARPELGHLCDNLKLDK

SEQ ID NO: 3775 - protein, 1160 aa, Triticum aestivum
WHSLREEPVIYINGRPFVLRDAERPFSNLEYTGINRERVEQMEFRLKEDILQEASRYGNKILVTDELPNGQMVDQWESVMSDTVKTPLEVYEELQHQGYLVDYERVPITDEKAPKEGDFDNLVHRISQVDMETEIVFNCQMGRGRTTTGMVISTLVYLNRIGASGIPRTSSIGKVFYAGNDLDDYSPSSEEAILRGEYAVIRSLVRVLEGGVEGKRQVDKVIDKCDSMQNLREAIATYRNSTLRQPDEMKREASLSFFVEYLERYYFLICFAVYVHSVSSAHQATSSGVSFSDWMRARPELYSILRRLLRRDPMGALGYSSSKPTLPKIIESADGRPHEMDVVAAMRNGEVLGRQTVLKSDHCPGCHNLNLPERVEGAPNFREIPGFSVYGVANPTVDGIRAVIQRVSTSKGNRPILWHNMREEPVIYIHGKPFVLREVERPYKNMLEYTGIGRDRVERMEARLKEDILREAERYDGAIMVIHETDNGEIFDAWENVNNEAVLTPLEVYKCLDSEGLPIKYARVPITDGKAPKSSDFDTVAFNVAAACKDAALVFNCQMGRGRTTTGTVIACLLRLRINNGRPIGMPAIQNNHEDTTDADYSSGEETMDHNGHLNSESWKPHTLTELHPRFDINDILLLRKITRLFDNGIECRQILDTVIDKCSALQNIRQAVLQYTKVINQQNMEPRVRRVALNRGAEYLERYLKLIAFSAYLGSEAFDGFCGQGETKISFKNWLQQRPEIQTMKWSIRLRPGRFFTVPDEHKATCQPSIVKARNGSVLGKGSILKMYFFPGQRRSSSMNFRGTPHVIKVDGYPVYSMATPTVDGAREVLSYLGCKDATGRDIIQKVVITDLREEVVVYIKGTPFVLRELDQPVDTLKHVGISGPMVENIEARLKEDILSEVKQLEGRLLLHQEEFNTATNQCSVLGYWEHIDLEDVMTPAEVYSTLRDQGYCIDYKRIPLTREREALAADVDSIQSSINESSRYYLFISHTGYGGVAYAMAITCLRLGADAKFVMEQTAETHFVSSSLTKSVSVKTFTDIALRQGDYRDILNLTRALIHGPKSKEEVDKVIDRCVGAGDLREDILQYRKALRDCSHDDDDEARSYLMDMGTKALRRYFFLITFRSYVHCTSLHEVTFASWMEARPELGHLCDNLKLDR

SEQ ID NO: 3776 - protein, 756 aa, Zea mays
MQKSDHHEQKLTSPRGLIHKILRRTNSRRSPTAADQQPSPVSPETSNSSIFSKQKDVDDAIKDSEKLSTHTIRIEDEKSDLLGSEIYSGKLTLDNKTKSSSNEQSGSGSSSNCFDARLSTEALIWGSNILKLEDIVSVSYNSGLRYFTVHACPLEKISSGLSCFMKPRRTQTDLKFVSSSPHEAFRWVNSFADQQCYVNLLPHPMASSKKHSSELIQFDAMFDPYVKCRSPPKILVILNPRSGHGRSSKVFHGKVEPIFKLAGFKMEVVKTTHAGHAKSLVSTIDFSTCPDGIVCVGGDGIVNEVLNGLLCRDDQNMSASVPIGIIPAGSDNSLIWTVLGVKDPISAALSIVRGGLTPIDVFSVEWIQSGTMHYGTTVSYFGFVSDVLELSEKYQKHFGPLRYFVAGFLKFLCLPKYSFELEYLPVSDVNGAEHKILVGQEKVDASDLYDDVIRRSRAECLPRASSLSSIDSIMSTGIMSGAELEVCSPRANNEPSEVVRGLDPKSKRLSLGRASTFKEPEEVLHPHSHGTSTPSWRRSKSKSRTEKAKPGLSATHDAKSSKVNADKEDTSSTISDPGPVAVWDSGPKWDDEPKWDNQPNWEPETSIELHSPREDIELGLTKELVPSLDERWTVRKGRYLGVLVCNHSCKTVQSLSSQVVAPKAEYDDNCLDLLLVGGSGRLRLLRFLVLLQFGKHISLPNVEYVKVKSVRLKAGPNTHDGCGIDGELLHVKGQVRCSLLPQQCQLMGRPVKNPVQ

SEQ ID NO: 3777 - protein, 755 aa, Setaria italica
MQKSDHHEQKLTSPRGLIHKILRRTNSRRSPTAAEQQTSPVSPETSNAIFSKQKDPDDVINDPEKASTHSIRIEDEKSDLLGYEVYSGKLTLDNRARSASSEQSGSGSSGNCFDARLSTEALIWGSNVLKLEDIVSVSYNSGLRYFTVHSCPLEKRSSGLSCFMKPRRTQKDLKFLSPSPHEAFRWVNSFADQQCYVNLLPHPMASSKKHSSELIPFDAMLDPYVKSRSPPRILVILNPRSGHGRSSKVFHGKVEPIFKLAGFKMEVIKTTHAGHAKSLVSTIDFSTCPDGIVCVGGDGIVNEVLNGLLCRDDQNVSASVPIGIIPAGSDNSLVWTVLGVKDPISAALSIVRGGLTPIDVFSVEWIQSGIMHYGTTVSYFGFVSDVLALSEKYQKRFGPLRYFVAGFLKFLCLPKYSFEVEYLPISDANGAEHKILVGQEKVDASDLYDDVVRRSRAECLPRASSLSSIDSIMSTGIMSGAELEVCSPRANNEPSELVRALDPKSKRLSLGRASTFKEPEEVLHPQSHGTSTPSWRRSKSKSRTEKAWPGLTSTNDAKSSKVNTAHDKEDTSSTISDPGPVWDSGPKWDAEPKWDNQPNWEPETSIELHSPQEDIELGLTKELVPSLDERWTVRKGRYLGVLVCNHSCKTVQSLSSQVVAPKAEYDDNCLDLLLVGGSGRLRLLRFFVLLQFGKHISLPNVEYVKVKSVRLKAGPNTHDGCGIDGELLHVKGQVRCSLLPQQCQLIGRPAKNPVQ

SEQ ID NO: 3778 - protein, 755 aa, Panicum virgatum
MQKSDHHEQNLTSPRGLIHKILRRTNSRRSPTAAEQQTSPVSPETSNTIFSKQKDPDDVINDPEKASTHSIRIEDEKSDLLGCEVYSGKLTLDNRTKSASSEQSGSGSSSNCFDARLSTEALIWGSNILTLEDIISVSYHSGLRYFTVHSCPLEKRSSGFSCFMKPRRTQKDLKFLSTSPHEAFRWVNSFADQQCYVNLLPHPMVSSKKHSSELIPFDAMLDPYVKCRSPPKILVILNPRSGHGRSSKVFHGKVEPIFKLAGFKMEVVKTTHAGHAKSLVSTVDFSTCPDGIVCVGGDGIVNEVLNGLLCRDDQNVAASVPIGIIPAGSDNSLVWTVLGVRDPISAALSIVRGGLTPIDVFSVEWIQSGTMHYGTTVSYFGFISDVLELSEKYQKRFGPLRYFVAGFLKFLCLPKYSFELEYLPVSDVNGAEHRILAGQEKVDASYLYDDVVRRSRAECLPRASSLSSIDSIMSTGIMSGAELEVCSPHANNEPSELVRALDPKSKRLSLGRASTFKEPEEVLHPPAHGTSTPSWRRSKSKSRTEKVWPGLTVTNDAKSSKVNMAHDKEDTSSTISDPGPVWDSGPKWDAEPKWDNQPNWEPETPIELHSPREDIELGLTKELVPSLDERWTVRKGRYLGVLVCNHSCKTVQSLSSQVVAPKAEFDDNCLDLLLVGGSGRLRLLRFLVLLQFGKHISLPNVEYVKVKSVRLKAGPNTHDGCGIDGELLHVKGQVRCSLLPQQCQLIGRPAKNPVQ

SEQ ID NO: 3779 - protein, 757 aa, Oryza sativa
MEIQKSDHHEQNLTSPRGLIHKVLRRTSSRRSPTAADHNPSPVFLETSNSKFLKQKDIDDAIKDPEKAGTHDNRIEDEKSDLLGYEICSGKLTLDNKAKSASGEQSGSGSSSNCFDARLTTEALVWGSNILKLEDIVSVSYHSGLRHFTVHACPLEKRSSGLSCFMKPRKIQKDLRFLSTSPHEAFRWVNGFADQQCYVNLLPHPMASSKKHSSELIPFDNMFDPCVKCRSPPKILVILNPRSGHGRSSKVFHGKVEPIFKLAGFKMEVVKTTHAGHAKSLVSTIDFSTCPDGIVCVGGDGIVNEVLNGLLCRDDQNVAVSVPIGIIPAGSDNSLVWTVLGVKDPISAAMSIVRGGFTPIDVFAVEWIQSGTIHFGTTVSYFGFVSDVLELSERYQKRFGPLRYFVAGFLKFLCLPKYNFELEYLPISDGGGGEHKIVEGQDKVDASDLYDDVVRRSRVECLPRASSLSSIDSIMSTGIMSGGDLEVSSPHANNEPSELVRALDPKSKRLSLGRTSTFKEPEEVIHPQAHVSSTPNWRRSKSKSRTEKAWPGSGATNDANSSRGTTTHDKEDASSTISDPGPVWDSGPKWDDEPKWDNQPNWEPETPIDLPGPLDDIELGLTKELVPSLDERWTVRKGRYLGVLVCNHSCKTVQSLSSQVIAPKAEYDDNCLDLLLVGGSGRLRLLKFLVLLQFGKHISLPNVEYLKVKSVRLKAGPNTHDGCGIDGELLHVKGQVRCSLLPQQCRLIGRPAKNPVQ

SEQ ID NO: 3780 - protein, 752 aa, Secale cereale
MQKSDHHEQNLTSPRGLIHKVLRRTNSRRSPTAAEQDPSPVFPETSNTKFLKQKNVEVAIKDPEKGSTHDTRIEDEKSDLLGYEVCSGKLTLDNKGRSVSGEQSGSGSSGNCFDARLTTEALVWGSNILKLEDIVSVSYNSGLRHFTVHACPLEKRSNGLSCFMKPRRIQKDLRFLSTAPHEAFRWVNGFADQQCYVNLLPHPMASSKKHSSELIPFDGMLDPYVKCRSPPKILVILNPRSGHGRSSKVFHGKVEPIFKLAGFKMEVIKTTHAGHAKSLVSTIDFSTCPDGIVCVGGDGIVNEVLNGLLCRDDQTEAGSVPIGIIPAGSDNSLVWTVLGVKDPISAALSIVRGGFTPIDVFSVEWIQSGTTHFGTTVSYFGFVSDVLELSEKYQKRFGPLRYIVAGFLKFLCLPKYSFELEYLPVADVDGAGHKIVEGQEKVDTSDLYDDVVQRSRAECLPRASSLSSIDSIMSTSIMSGGEPEVSSPHANNEPSELVRALDPKSKRQSLGRTSTFKEPEELLHPQASTPSWRRSKSKSRTEKAWPGLTATNDTKPSKGTTTHDKEDTSSTVSDPGPAWDTGPKWDLEPKWDNQPNWEPETPIELHGPSDDIELGLTKELVPSLDERWVIRKGRYLGVLVCNHSCKTVQSLSSQIVAPKAEYDDNCLDLLLVGGSGRLRLLRFLVLLQFGKHISLPNVEYVKVRSVRLKAGPNTHDGCGIDGELLHVKGQVRCSLLPQQSRLIGRPAKNPVQ

SEQ ID NO: 3781 - protein, 752 aa, Triticum aestivum
MQKSDHHEQNLTSPRGLIHKVLRRTNSRRSPTAAEQDPSPVFPETSNTKFLKQKNVEDASKDPEKGSTHDNRIEDEKSDLLGYEVCSGKLTLDNKDRSVSGEQSGSGSSGNCFDARLTTEALVWGSNILKLEDIVSVSYNSGLRHFTVHACPLEKRSNGLSCFMKPRRIQKDLRFLSTAPHEAFRWVNGFADQQCYVNLLPHPMASSKKHSSELIPFDAMLDPYVKCRSPPKILVILNPRSGHGRSSKVFHRKVEPIFKLAGFKMEVIKTTHAGHAKSLVSTIDFSTCPDGIVCVGGDGIVNEVLNGLLCRDDQIEAGSLPIGIIPAGSDNSLVWTVLGVKDPISAALSIVRGGFTPIDVFSVEWIQSGTTHFGTTVSYFGFVSDVLELSEKYQKRFGPLRYIVAGFLKFLCLPKYSFELEYLPAADVDGAGHKIVEGQEKVDTSDLYDDVVQRSRAECLPRASSLSSIDSIMSTSIMSGGEPEVSSPRANNEPSELVRALDPKSKRQSLGRTSTFKEPEESLHPQASTPSWRRSKSKSRTEKAWPGLTATNDTKPSKGTTTHDKEDTSSTISDPGPAWDTGPKWDMEPKWDNQPNWEPETPIELHGPSDDIELGLTKELVPSLDERWVIRKGRYLGVLVCNHSCKTVQSLSSQIVAPKAEYDDNCLDLLLVGGSGRLRLLRFLVLLQFGKHISLPNVEYVKVRSVRLKAGPNTHDGCGIDGELLHVKGQVRCSLLPQQSRLIGRPAKNTVQ

SEQ ID NO: 3782 - protein, 752 aa, Triticum aestivum
MQKSDHHEQNLTSPRGLIHKVLRRTNSRRSPTAAEQDPSPVFPETSNTKFLKQKNVEGASKDPEKGSTHDNRIEDEKSDLLGYEVCSGKLTLDNKGRSVSGEQSGSGSSGNCFDARLTTEALVWGSNILKLEDIVSVSYNSGLRHFTVHACPLERRSNGLSCFMKPRRIQKDLRFLSTAPHEAFRWVNGFADQQCYVNLLPHPMASSKKHSSELIPFDAMLDPYVKCRSPPKILVILNPRSGHGRSSKVFHGKVEPIFKLAGFKMEVIKTTHAGHAKSLVSTIDFSTCPDGIVCVGGDGIVNEVLNGLLCRDDQIEAGSLPIGIIPAGSDNSLVWTVLGVKDPISAALSIVRGGFTPIDVFSVEWIQSGTTHFGTTVSYFGFVSDVLELSEKYQKRFGPLRYIVAGFLKFLCLPKYSFELEYLPVADVDGAGHKIVEGQEKVDTSDLYDDVVQRSRAECLPRASSLSSIDSIMSTSIMSGGEPEVSSPRANNEPSELVRALDPKSKRQSLGRTSTFKEPEESLHPQASTPSWRRSKSKSRTEKAWPGLTATNDTKPSKGTTTHDKEDTSSTISDPGPAWDTGPKWDMEPKWDNQPNWEPETPIELHGPSDDIELGLTKELVPSLDERWVIRKGRYLGVLVCNHSCKTVQSLSSQIVAPKAEYDDNCLDLLLVGGSGRLRLLRFLVLLQFGKHISLPNVEYVKVRSVRLKAGPNTHDGCGIDGELLHVKGQVRCSLLPQQSRLIGRPAKNTVQ

SEQ ID NO: 3783 - protein, 752 aa, Triticum aestivum
MQKSDHHEQNLTSPRGLIHKVLRRTNSRRSPTAAEQDPSPVFPETSNTKFLKQKNVEVASKDPEKGSTHDNRIEDEKSDLLGYEVYSGKLTLDNKGRSVSGEQSGSGSSGNCFDARLTTEALVWGSNILKLEDIVSVSYNAGLRHFIVHACPLEKRSNGLSCFMKPRRIQKDLRFLSTAPHEAFRWVNGFADQQCYVNLLPHPMASSKKHSSELIPFDAMLDPYVKCRSPPKILVILNPRSGHGRSSKVFHGKVEPIFKLAGFKMEVIKTTHAGHAKSLVSTIDFSTCPDGIVCVGGDGIVNEVLNGLLCRDDQIEAGSVPIGIIPAGSDNSLVWTVLGVKDPISAALSIVRGGFTPIDVFSVEWIQSGTTHFGTTVSYFGFVSDVLELSEKYQKRFGPLRYIVAGFLKFLCLPKYSFELEYLPVADVDGAGHKIVEGQEKVDTSDLYDDVVQRSRAECLPRASSLSSIDSIMSTSIMSGGEPEVSSPHANNEPSELVRALDPKSKRQSLGRTSTFKEPEELLPPQASTPSWRRSKSKSRTEKAWPGLTATNDTKPSKGTTTHDKEDTSSTVSDPGPAWDTGPRWDLEPKWDNQPNWEPETPIELHGPSDDIELGLTKELVPSLDERWVIRKGRYLGVLVCNHSCKTVQSLSSQIVAPKAEYDDNCLDLLLVGGSGRLRLLRFLVLLQFGKHISLPNVEYVKVRSVRLKAGPNTHDGCGIDGELLHVKGQVRCSLLPQQSRLIGRPAKNPVQ

SEQ ID NO: 3784 - protein, 748 aa, Brachypodium distachyon
MQKSDNHEQKLTSPRGLIHKVFRRTNSRRSPTAAEQDPSPVFPETSNAKFLKQNNSEDAIKDQEKASTHDNRIEDEKSDLLGYEVCSGKLTLDYKGRSVSAEQSSGNCYDARLTTEAFVWGSNILKLEDIVSVSYNSGLRHFTVHACPLEKRSIGLSCFMKPRRSQKDLRFLSAAPHEAFQWVNGFADQQCYVNLLPHPMASSKKHSSELIPFDAMLDPYVKCRSPPKILVILNPRSGHGRSSKVFHGKVEPIFKLAGFKMEVVKTTHAGHAKSLVSTIDFSTCPDGIVCVGGDGIVNEVLNGLLCRDDQNESVSIPIGIIPAGSDNSLVWTVLGVKDPISAALSIVRGGFTPIDVFSVEWIQSGTTHFGTTVSYFGFVSDVLELSEKYQKRFGPLRYIVAGFLKFLCLPKYSFELEYLPVSNADGPEHKTVEGQEKVDTSDLYDDVVQRSRAECLPRASSLSSIDSVMSTSIMSGGEPEVSSPHANNEPSELVRALDPKSKRLSLGRTSTFKEPEEVLHPQASTPSWCRSKSKSRTEKAWPGLTTTNDTKSSRGTTTHDKEDTSSTVSDPGPAWDTGPKWDMEPKWDNQHNWESETPIELHGPSDDIELGLTKELVPSLDERWVVRKGRYLGVLVCNHSCKTVQSLSSQVVAPKAEYDDNCLDLLLVGGSGRLRLLRFLVLLQFGKHISLPHVEYLKVKSVRLKAGPNTHDGCGIDGELLHVKGQVRCSLLPQQCRLIGRPAQNPVQ

SEQ ID NO: 3785 - protein, 132 aa, Setaria italica
MGLLDKLWDDTVAGPRPDTGLGRLRKQPARPAAVKINDPAGDATAFVPPSPASGSEETPVKVTRSIMIKRPAGYPSSPRSAASTPPASPLGTTPPISPFAGAGGRFRRKSSSDAYERASPPGTTSHPPPFEV

SEQ ID NO: 3786 - protein, 132 aa, Zea mays
MGLLDKLWDDTVAGPRPDTGLGRLRKQPARPAAVKISDPAGDAAALVPPSPASGSEETPVKVTRSIMIKRPAGYPSSPRSAASTPPASPLGTTPPISPFAGAGGRFRRKSSSDAYERATPPGTTSHPPPFEV

SEQ ID NO: 3787 - protein, 132 aa, Panicum virgatum
MGLLDKLWDDTVAGPRPDTGLGRLRKQPVRPAAVKINDPAGDAAAFVPPSPASGSEETPVKVTRSIMIKRPAGYPSSPRSAASTPPASPLGTTPPISPFAGAGGRFRRKSSSDAYERASPPGTTSPTPPFEV

SEQ ID NO: 3788 - protein, 132 aa, Zea mays
MGLLDKLWDDTVAGPRPDTGLGRLRKQPVRPAAVKISDPAGDAAAFVPPSPASGSEETPVKVTRSIMIKRPAGYPSSPRSAASTPPASPLGTTPPISPFAGAGGRFRRKSSSDAYERATPPGTTSHPPPFDV

SEQ ID NO: 3789 - protein, 132 aa, Pennisetum glaucum
MGLLDKLWDDTVAGPRPDTGLGRLRKQPVRPAAVKINDPAGDAAAFVPPSPASGSEETPVKVTRSIMIKRPAGYPSSPRSAASTPPASPLGTTPPISPFAGAGGRFRRKSLSDAYERASPPGTTSHPPPFEV

SEQ ID NO: 3790 - protein, 132 aa, Saccharum officinarum
MGLLDKLWDDTVAGPRPDTGLGRLRKQPVRPAAVKINDPAEDAAVFVPPSPASGSEETPVKVTRSIMIKRPAGYPSSPRSAASTPPASPLGTTPPISPFAGAGGRFRRKSSSDAYERATPPGTTSHPPSFEV

SEQ ID NO: 3791 - protein, 132 aa, Panicum virgatum
MGLLDKLWDDTVAGPRPDTGLGRLRKQPARPAAVKINDPAGDAAAFVPPSPASGSEETPVKVTRSIMIKRPAGYPSSPRSAASTPPASPLGTTPPFSPFAGAGGRFRRKSSSDAYERASPPETTSRTPPFEV

SEQ ID NO: 3792 - protein, 54 aa, Cenchrus ciliaris
EALGEGNPSVNTTAEGGMGLLDKLWDDTVAGPPLEERPRPPPQAAGAPRRRQDQ

SEQ ID NO: 3793 - protein, 133 aa, Oryza sativa
MGLLDKLWDDTVAGPRPDTGLGRLRKHAAARPAAVKINDPTGDAAMVAVPPTTPAGAEEAPVKVTRSIMIKRPAGYPASPRSAASTPPASPAGSTPPISPFAGAGGRFRRKSSSDAYERATPGTTSHPPPFEV

SEQ ID NO: 3794 - protein, 133 aa, Pseudoroegneria spicata
MGLLDKLWDDTVAGPQPDTGLGRLRKLAARPAAVKITDVAPDAATVIPPTTPAGGEDAPMKVTRSIMIKRPAGYPSSPRSAASTPPASPLGCTPPISPFAGAGGRFRRKSSSDAYERATTPGASTSHPPPFEV

SEQ ID NO: 3795 - protein, 134 aa, Brachypodium distachyon
MGLLDKLWDDTVAGPRPDTGLGRLRNLASRPAAVKINDVAADAAPKVIPPTTPAGGEDAPVRVTRSIMIKRPAGYPSSPRSAASTPPASPAGSTPPISPFAGAGGRFRRKSSSDAYERATPPGPSTSHPPPFEV

SEQ ID NO: 3796 - protein, 134 aa, Hordeum vulgare
MGLLDKLWDDTVAGPQPDTGLGRLRKLAARPAAVKINDVAPDAATVIPPTTPASGGDAPMKVTRSIMIKRPVGYPSSPRSAASTPPASPLGSTPPISPFAGGGGRFRRKSSSDAYERATPPGASTSHPPPPFEV

SEQ ID NO: 3797 - protein, 134 aa, Pseudoroegneria spicata
MGLLDKLWDDTVAGPQPDTGLGRLRKLAARPAAVKINDVTPDAATVIPPTTPASGGDAPMKVTRSIMIKRPAGYPSSPRSAASTPPASPLGSTPPISPFAGGGGRFRRKSSSDAYERATPPGASTSHPPPPFEV

SEQ ID NO: 3798 - protein, 132 aa, Secale cereale
MGLLDKLWDDTVAGPQPDTGLGRLRKLAARPAAVKINDVAPGAATVIPPTTPASGEDAPMKVTRSIMIKRPAGYPSSPRSAASTPPASPLGTTPPISPFAGGGGRFRRKSSSDAYERAAPPGASTSHPPPPL

SEQ ID NO: 3799 - protein, 134 aa, Triticum aestivum
MGLLDKLWDDTVAGPQPDTGLGRLRKLAARPAAVKINDVAPGAATVIPPTTTAGGEDAPMKVTRSIMIKRPAGYPSSPRSAASTPPASPLGTTPPISPFAGGGGRFRRKSSSDAYERATPPGASTSHPPPPFEV

SEQ ID NO: 3800 - protein, 219 aa, Saccharum officinarum
MAAAARPSNATLLARLRDGTAKFELLDDSALAHAPPAWPRLHCFARVASSLRGGWSAALNKVEHYGVQRVTGDGRCMFRALAKGMAKNKGIPLAPREEVQDADDLRMAVKEIICDRETERQEYEEAVIAITMEQSLKRYCQRIRRPDFWGGESELLVLSRLCRQPIIIYIPEREYHGRGNGFIPIAEYGLEFTKNTKQWKKKTPVRLLYSGRNHYDLLV

SEQ ID NO: 3801 - protein, 221 aa, Zea mays
MAAAARPSNATLLARLRDGTAKFELLDDSAFALAHAPPAWPRLHCFARIAPSLRGGWSAALNKVEHYGVQRVTGDGRCMFRALAKGMAKNKGIPLAPREEVEDADDLRMAVKEIICDSETGRQEYEEAVIAITVEQSLKRYCQRIRRPDFWGGESEFLVLSRLCRQPIIIYIPEREYHGRGNGFIPIAEYGLEFTKNTKQWKKKTPVRLLYSGRNHYDLLV

SEQ ID NO: 3802 - protein, 217 aa, Cynodon dactylon
MAAAARPSNATLLARLRDGTAKFELLEESAPAPPSWPRLHCFARISSSLRGGWSAALNKVEHYGIQRVTGDGRCMFRALVKGMAKNKGIPLTPREEVQDADDLRMAVKEVICDSAAERQKYEEAIIAITVEQSLKRYCQRIRRPDFWGGESELLVLSKLCQQPIIIYIPEHEYHGRGNGFIPIAEYGLEFTKNSKQWKKKMPVRLLYSGRNHYDLLI

SEQ ID NO: 3803 - protein, 219 aa, Triticum aestivum
MAPPARPSNATLLARLGEGTARFELLEDPAPAPAPPVWPRLHCFARIGSSLRGGWSAALNKVEHYGVQRVTGDGRCMFRALAKGMAKTRGIPLTPREEVQDADDLRLAVKEVICDNQTERQKYEEAIIAITVDESLKRYCQRIRRPDFWGGESELLVLSRLCRQPIIIYIPEREYRGRGNGFIPIAEYGLEFTKDSKEGKKRVPVRLLYSGKNHYDLLI

SEQ ID NO: 3804 - protein, 143 aa, Panicum virgatum
MFRALAKGMAKNKGIPLTPREEVQDADDLRMAVKEIICDSETERQKFEEAVIAITVEQSLKRYCQRIRRPDFWGGESEFLVLSRLCRQPIIIYIPEREYHGRGNGFIPIAEYGLEFAKNSKNWKKKAPVRLLYSGRNHYDLLI

SEQ ID NO: 3805 - protein, 224 aa, Oryza sativa
MAQAVRPCNATLLARLRDGEARFELLEDSAAAAAASPAPAPVWPGLSCFSRVATSLRGGWSGALNKVEHYGVQRVTGDGRCMFRALVKGMAKNKGIPLTSREEVQDADDLRMAVKEVICDDETERQKYEEAVIAITVDESLRRYCHRIRRSDFWGGESELLVLSKLCRQPIIIYIPEREYHGRGNGFIPIAEYGLEFSKDSKQWKKKVPVRLLYSGRNHYDLLV

SEQ ID NO: 3806 - protein, 216 aa, Hordeum vulgare
MAPPVRPSNATLLARLGEGTARFELLEDPAPAPVWPRLHGFARIGSSLRGGWSAALNKVEHYGVQRVTGDGRCMFRALAKGMAKTRGIPLTPREEVQDADDLRLAVKEVICDNQTERQKYEEAIIAITVDESLKRYCQRIRRPDFWGGESELLVLSRLCRQPIIIYIPEREYRGRGNGFIPIAEYGLEFTKDSKEGKKRVPVRLLYSGKNHYDLLI

SEQ ID NO: 3807 - protein, 219 aa, Brachypodium distachyon
MEPAARPSNATLLARLGEGAARFELVDGAAPDPAPPVWPRLHCFARIGSSLRGGWSAALNKVEHYGVQRVTGDGRCMFRALAKGMAKSRGIPLSAMEEVQDADDLRLAVKEVLCDNQTERQKYEEAIIAITVDESLKRYCQRIRRPDFWGGESELLVLSRLCRQPIIIYIPEHEYRGRGNGFIPIAEYGLEFTKNSKERKKRVPVRLLYSGRNHYDLLI

SEQ ID NO: 3808 - protein, 428 aa, Saccharum officinarum
MASWDNLGELSNIAQLTGLDAVKLISLIVRAASTARLHKRNCRRFAQHLKLIGGLLEQLRVSELRKYPETREPLEQLEDALRRGYLLVNSCQDRSYLYLLAMGWNIVYQFRKAQSEIDNYLRLVPLITLVDNARIRDRLEYIERDQCEYSFDEEDKKVQDALLNPDPCTNPTIVLKKTLSCSYPNLPFNEALRKESEKLQVELQRSQSNMDLGSCEVIQHLLGVTKTVESTIPEEETNAKASEKKGSNYSESKGDSAKSFDDDDDYPKKQKDDYPKKQKDTCSTQRCSSQVSYGHDLVSSRGSYSDEWHADLLGCCSEPALCLKTLFFPCGTFSRISSVAKDRPMSSGEACNDIMAYSLILSCCCYTCCVRRKLRQKLDIAGGCCDDFLSHLLCCCCALVQEWREVEIRGAYSEKTKVTPPPCQYMEH

SEQ ID NO: 3809 - protein, 428 aa, Zea mays
MASWDNLGELSNIAQLTGLDAVKLISLIVRAASTARLHKRNCRRFAQHLKLIGGLLEQLRVSELRKYPETREPLEQLEDALRRGYLLVNSCQDRSYLYLLAMGWNIVYQFRKAQSEIDNYLRLVPLITLVDNARIRDRLEYIERDQCEYSFDEEDKKVQDALLNPDPCSNPTIVLKKTLSCSYPNLPFNEALRKESEKLQVELQRSQSNMDLGSCEVIQHLLGVTKTVESTIPEKETNVKAPEKKGSNYSESKGETAKSFDDDDDYPKKQNDDYPKKQKETCSTQRCSSQVPYGHDLVSSRGSYSDEWHADLLGCCSEPALCLKTLFFPCGTFSRIASIAKDRPMSSGEACNDIMAYSLILSCCCYTCCVRRKLRQKLDIAGGCCDDFLSHLLCCCCALVQEWREVEIRGAYSEKTKVTPPACQYMEH

SEQ ID NO: 3810 - protein, 418 aa, Setaria italica
MASWDNLGELSNIAQLTGLDAVKLISLIVKAASTARMHKSNCRRFARHLKLIGGLLEQLRVSELRKYPETREPLEQLEDALRRGYLLVNSCQDRSYLYLLAMGWNIVYQFRKAQSEIDNYLRLVPLITLVDNARIRDRLEYIERDQCEYSFDEEDKKVQDALLNPDPCTNPTIVLKKTLSCSYPNLPFNEALKKESEKLQVELQRSQSHMDLGSCEVIQHLLGVTKTVACTIPEEETNAKVSEKDSNYKESKGDVAKSYDDDDYPKKQKDACSTQRCSSPVSYGHDLVSRRGSYSDEWHADLLGCCSEPALCLKTLFFPCGTFSRIASVAKDRPMSSGEACNDIMAYSLILSCCCYTCCVRRKLRQKLDIAGGCCDDFLSHLLCCCCALVQEWREVEIRGAYGEKTKTTPPPCQYMEH

SEQ ID NO: 3811 - protein, 417 aa, Panicum virgatum
MASWDNVGELSNIAQLTGLDAVKLISLIVKAASTARLHKRNCRRFAQHLKLIGGLLEQLRVSELRKYPETREPLEQLEDALRRGYLLVNSCQDRSYLYLLAMGWNIVYQFRKAQNEIDNYLRLVPLITLVDNARIRDRIEYIERDQCEYSFDEEDKKVQDALLNPDPCTNPTIVLKKTLSCSYPNLPFNEALKKESEKLQVELQRSQSNMDLSSCEVIQHLLGVTKTVACTIPEEGTNAKVSEKKDSNYNESKGDGAKSYDDDDYPKKPKDTCSAPRSPVSYGHDPVSRRGSYSDEWHADLLGCCSEPALCFKTLFFPCGTFSRIASVAKDRPMSSGEACNDIMAYSLILSCCCYTCCVRRKLRQKLDIAGGCCDDFLSHLLCCCCALVQEWREVEIRGAYGEKTKTTPPPCQYMEH

SEQ ID NO: 3812 - protein, 417 aa, Panicum virgatum
MASWDNVGELSNIAQLTGLDAVKLISLIVKAASTARMHKSNCRRFARHLKLIGGLLEQLRVSELRKYPETREPLEQLEDALRRGYLLVNSCQDRSYLYLLAMGWNIVYQFRKAQNEIDNYLRLVPLITLVDNARIRDRIEYIERDQCEYSFDEEDKKVQDALLNPDPCTNPTIVLKKTLSCSYPNLPFNEALKKESEKLQVELQRSQSNMDLSSCEVIQHLLGVTKTVACTIPEEGTNAKVSEKKDSNYNESKGDGAKSYDDDDYPKKPKDTCSAPRSPVSYGHDPVSRRGSYSDEWHADLLGCCSEPALCFKTLFFPCGTFSRIASVAKDRPMSSGEACNDIMAYSLILSCCCYTCCVRRKLRQKLDIAGGCCDDFLSHLLCCCCALVQEWREVEIRGAYGEKTKTTPPPCQYMEH

SEQ ID NO: 3813 - protein, 419 aa, Panicum virgatum
MASWDNVGELSNIAQLTGLDAVKLISLIVKAASTARMHKSNCRRFARHLKLIGGLLEQLRVSELRKYPETREPLEQLEDALRRGYLLVNSCQDRSYLYLLAMGWNIVYQFRKAQNEIDNYLRLVPLITLVDNARIRDRIEYIERDQCEYSFDEEDKKVQDALLNPDPCTNPTIVLKKTLSCSYPNLPFNEALKKESEKLQVELQRSQSNMDLGSCEVIQHLLGVTKTVACTIPEEGTNAKISEKKDSNYNESKGDGAKSYDDDDYPKKPKNTSSAPGCSSPVSYGHDPVSRRVSYIDEWHADLLGCCSEPALCFKTLFFPCGTFSRIASVAKDRPMSSGEACNDIMAYSLILSCCCYTCCVRRKLRQKLNIAGGCCDDFLSHLLCCCCALVQEWREVEIRGAYGEKTKTTPPPCQFMEH

SEQ ID NO: 3814 - protein, 412 aa, Brachypodium distachyon
MASLGDVANVAQVTGLDAVRIIALIVKAASTARMHKRNCRRFAQHLKLIGGLLEQLRVSELKKYPETREPLEQLEEALRRGFLLVHSCQDRSYLYLLAMGWNIVYRFRTAQNEIDNYLRLVPLITLVDNARVRERIEYIERDQCEYSLDEEDKEVQDALLNPDPSTNHSIVLKKTLSCSYPNLPFNEALRKESEKLQVELQRSQSNMDMGQCEVIHHLLGVTKTVASSIPDESTNAKVTKKTDSNKTKVSEDSAQSYDYDSPKKQKDACDAPRSSSPVPYGHDLVSSTSDEWHADLLGCCSEPSLCLKTFFFPCGTFSRIASVAKNRPMSSSEACNDIMAYSLILSCCCYTCCVRRKLRQKLNIAGGCCDDFLSHVMCCCCALVQEWREVEIRGAYGEKTKVTPPPCQYMEH

SEQ ID NO: 3815 - protein, 418 aa, Oryza sativa
MASWENLGDVATVVQLTGLDAVRLISMIVKAASTARLHKRNCRRFAQHLKLIGGLLEQLRVSELKKYPETREPLEQLEDALRRAYLLVHSCQDRSYLYLLAMGWNIVYQFRKAQNEIDNYLRLVPLITLVDNARVRERMEYIERDQCEYSFDDEDKEVQDALLNPDPSTNPTVVLKKTLSCSYPNLPFNEALRKESEKLQVELQRSQSNMDMGQCEVIQHLLGVTKTVASSIPEKCATPKVSEKADSNHTKVSEDSAKTYHDDSPKKQKDACTAPRSSPPSSYGHDLVSSRGSYSDEWHADLLGCCSEPSLCLRTFFFPCGTFSKIASIAKNRPMSSSEACNDIMAYSLILSCCCYTCCVRRKLRQKLNIAGGCIDDFLSHLMCCCCALVQEWREVEIRGAYGERTKISPPSFQYMEH

SEQ ID NO: 3816 - protein, 415 aa, Triticum aestivum
MANVGDLANIAQLTGLDAVRLIGLIVKAAATARMHKSNCRRFAQHLKLIGGLLEQLRVSELKKYPETREPLEQLEDALRRGYLLVNSCQDRSYLYLLAMGWNIVYRFRTAQTEIDNYLRLVPLITLVDNARVRERIEYIERDQCEYSLDEEDKEVQEALLNPDPSTNPSIVLKKTLSCSYPNLPFNEALRKESEKLQVELQRSQSNMDMAQCEVIHHLLGVTRTVESSIPEESTDAKVTKKTKSKCTKVNEDSAKSYDDDSPKKQKDAYVAPRSSSPVPYNHDLVSSTASYSDEWHADLLGCCSEPALCLKTFFFPCGTFSRIASIAKNKPMSSGEACNDIMAYSLILSCCCYTCCVRRKLRQRLNIAGGCCDDFLSHVMCCCCALVQEWREVEIRGAYGGKTKITPPAHQYMEH

SEQ ID NO: 3817 - protein, 415 aa, Secale cereale
MANVGDLANIAQLTGLDAVRLIGLIVKAAATARMHKSNCRRFAQHLKLIGGLLEQLRVSELKKYPETREPLEQLEDALRRGYLLVNSCQDRSYLYLLAMGWNIVYRFRTAQAEIDNYLRLVPLITLVDNARVRERIEYIERDQCEYSLDEEDKEVQEALLNPDPSTNPSIVLKKTLSCSYPNLPFNEALRKESEKLQVELQRSQSNMDMAQCEVIHHLLGVTRTVERSIPDESTDAKVTKKTNSKCTKVNEDSAKSYDDDSPKKQKDAYIAPRSSSPVPYNHDLVSSTASYSDEWHADLLGCCSEPALCMKTFFFPCGTFSRIASIAKNKPMSSGEACNDIMAYSLILSCCCYTCCVRRKLRQRLNIAGGCCDDFLSHVMCCCCALVQEWREVEIRGAYGGKTKITPPAHQYMEH

SEQ ID NO: 3818 - protein, 415 aa, Secale cereale
MANVGDLANIAQLTGLDAVRLIGLIVKAAATARMHKSNCRRFAQHLKLIGGLLEQLRVSELKKYPETREPLEQLEDALRRGYLLVNSCQDRSYLYLLAMGWNIVYRFRTAQTEIDNYLRLVPLITLVDNARVRERIEYIERDQCEYSLDEEDKEVQEALLNPDPSTNPSIVLKKTLSCSYPNLPFNEALRKESEKLQVELQRSQSNMDMAQCEVIHHLLGVTRTVERSIPDESTDAKVTKKTNSKCTKVNEDSAKSYDDDSPKKQKDAYIAPRSSSPVPYNHDLVSSTASYSGEWHADLLGCCSEPALCMKTFFFPCGTFSRIASIAKNKPMSSGEACNDIMAYSLILSCCCYTCCVRRKLRQRLNIAGGCCDDFLSHVMCCCCALVQEWREVEIRGAYGGKTKITPPAHQYMEH

SEQ ID NO: 3819 - protein, 893 aa, Zea mays
MINLFELSVGASAKVSSRDGSPVRGTQSERKEYAGSKALTGSTRRSSSDRSGGTPMKMLIAQEMAKEGDANQKTTNVVARLMGLDDNVDLAKPVVPPNRRSFPDGHLSATLARVNNQIPFEKHTSSAEDVEYKDVYEVGYQPPRGDEYPRRRRPSEDHDKRRMDLVRQKFVEAKRLASHDNILQSKEFHDALEVLNSNKDLFLKFLEEPNSLFAKQSGGLGSAPTSPQRKHITVLKPSKSVEMKGDKAIRRQTNHAAGNRTDRSNVHKSDAAHVKEDKLPKHTRIVVLKPTSVIASMEQSEQSYHADLDDSEAPVLSRHLSDEIDWSVHGISRRHTESLQGCIQSNMFGADRPYHQYAEEEGNSLSDSDIGTPTSHHSWEYIYRFSNPYFGSLSHASCSPESHVTREAKKHASDRWATVPSSEMTQDKVPVRRSLSTLGEMLAMPDMKKEEAAEQASPDATHQLCEPTVGVSSNCAVGEGEGESSLRKISRSRSVPVSSTAFDSLRLDGGCLDAQHKEPTVPKEVKPKSGKSSLKGKITSFFSKRKKAEKEKPSPSPLGTLNGRGSSVSTVAVAKPDAPQHVCASSQDDVSFESLEDQFNHGPIGAPVDEPEAPSVSKPPASLEKTLSFEIRASHFDQPSPTSVFDVQFEDISEKSPISSESAITAKQEPLSRSIPIGSIARTLSWDDASQEAPPQCSTKGDSNHEQEQHEFVEKTLASAGFCNEKTQDIFARWHSLDRPLDPAVVEQLLERKVEDAKCRERRSNQRLLIDSVNAALLDIGQSKVWGGAYPCTARHYSNAPGVGTCDDDVLVTDEAWRLVRSWLFDDENDIAGLGDNAGLAADWVVGREIHGKGWAETLRMEVDEMSREICGEVLGELVGEAFSELAGAAGWH

SEQ ID NO: 3820 - protein, 884 aa, Setaria italica
MINLFDLSVGASAKVASRDGSPVRGTQSERKEYAGSKTVTGCTRRSSSDRSGGTPMKMLIAQEMAKEGDANQKTTNVVARLMGLDDNADLPKPLPSNRRTFPDGHLSATLARVNNQMSFEKRASSMEDVEYKDVYEVGYQPPRGECLSNESPRRPNEDHDKRRMDLVRQKFVEAKQLASHDNLLQSKEFHDALEVLNSNKDLFLKFLEEPNSLFAKQSGELHSAPTSPQRKRITVLKPSKSVDTRDDKAIKRQKNHAVDGNRVERSNSHKSDAAHVKVERLPKHTRIVVLKPTSAIASMEQFDQNYHADLDDSEAPAISRRLSDEIDWSVHGMCRRHNESNPMSAYRPYDQYAEEEGASLSDSDIGTPTSRHSWEYIYRFSNPYFGSSLSHASCSPESHVTKEAKKYTSDRWAIVPSSEITQGKVLVRRSLSTLGEMLAMPDMKKEEVADQASPDATSQLCSNEPTVGVSSNCAVGDGEGESSLRKISRSRSVPVSSSAFDSLRLDGGCSEAQHKESTASKDVKPKNGKSSLKGKISSFFSKRKKTEKEKVNPSPLGTPNSQVPSASTVVIDKSDVPEHVCTNLQNGVAFGYLEERFENGPTVVPLDELEAPSTSKSPVSLEKALPFEIRNSHFDQPSPTSVLDAQFDDVNEKSPISSERAITVKQEPLSRSLPIGSIARTLSWDDASQEASLCCTKGDSHEQEQYEFVEKILTSVGFCNEKAQDIFVRWHSLDCPLDPVVLDQLLERKVEDAKCRERRSNQRLLIDSVNAALLDIGQRKLWGAYPCTARYSNAPRVATCDVLVTDEAWRLVKSWLFDDENDIAGLGDNAGLAADWVVDKEIHGKGWSEMLRSEVDEISKEICGDVLSELVGEAFSELADAECH

SEQ ID NO: 3821 - protein, 890 aa, Panicum virgatum
MINLFDLSVGASAKVASRDGSPVRGTRSERMEYAGSKTVTGYTRRSSSDRSGGMPMKMLIAQEMAKEGDTSQKTANVVAKLMGLDDNMDLPKHPPSNRSFPDGHLSATLARVNNQMSYEKRASSIEDVEYKDVYEVGYQPPRGECLSSESPRRPYEDHDKQRMDLVRQKFIEAKQLASHDNILQSKEFHDALEVLNSNKDLFLKFLEEPNSLFAKQSGELHSAPTSPQRKRITVLKPSKSVDRKGDKAIKRQKKHAVDGNRAERSKNHKSDAAHLKVERLPKHTRIVVLKPTSTIASMEQFEQYYHADLDDSEAPAVSRRLSDEIDWSIHGMHRRHYESLQGCIQSDTISTGRPYDHHAEEGGTSLCDSNIGTPTSHHTWDYIYRFSNPYFGSSLSHASCSPEPHATREAKKYTSDRWEIVPSSEITQEKVAVRRSLSTLGEMLAMPDMKKEEVADQASPDATKQLCSNEPTVGVSSNCVVDVGEGGRSLRKISRSRSVPVSSLAFDSLRLDGGCSVSQHKESTVTKEVKPKNGKSSLKGKISSFFSKRKKAEKEKVSPSPVGTPNNQVLSASTAEIGKSDVPEHVCTSLQDGVALGYLEERFENELTVVPVHELKAPSTSKSPVSLEKALSFEIHNSHFDQPSPTSVLDAQFEDVNEKSPISSESAITVKQEPLSRSLPIGSIARTLSWDDASQEAPLCCAQDDSHEQEQYEFVEKILTSAGFCNEKAKDIFVRWHSLDCPLDPVVFDQLLERKVEDAKCRERRSNQRLLIDSVNVALLDIGQSKLWGAYPCTARYSNAPRVATCDVLVIDEAWRLIRSWLLDDENDIAGLGDHAGLAADWVVCKEIHGKGWSEMLRLEVDEISKEICGDVLNKLVEEAFSELADAGCH

SEQ ID NO: 3822 - protein, 551 aa, Zea mays
MAARPDARSGYCAATRTFRSKRADVPLPADADLDVVRFLASRRHAGVVALVDAATGHRVTFQELWRAVEGAATALAAPPLSLRKGQVALILSPNSVHFPVAALAAMSLGAVLTTANPLNTPAEIAKQVADARPVVAFTTRDLLPKLPRAGAGAGIRVVLLEPDRLPSDPSPVVATIGEISATPPDPTRRRDRVTQDDPATLLYSSGTTGPSKGVVATHRSLISMVQIIMSRFRLEASNRTETFLCTVPMFHVYGLVAFATGLLGCGATIVVLSKYELPEMLRAINEYGVTYLPLVPPILVAMLAHPNRLPLGGLRKVLSGGAPLSKELIEGFKEKYPQVEILQGYGLTESTAIGASTDSAEESSRYGTAGLLSPSTEAKIVDPETGEALPVNRTGELWIRGPYVMKGYFKNAEATQSTLTPDGWLKTGDLCYIDEDGYLFVVDRLKELIKYKGYQVPPAELEALLLTHPEIEDVAVIPFPDREVGQFPMAYVVRKKGSNLSEREVMEFVAKQVAPYKKVRKVAFVAEIPKNASGKILRKDLIKLATSKSKL

SEQ ID NO: 3823 - protein, 548 aa, Setaria italica
MAPPEVDPRSGYCAATRSFRSKRAPVPLPADRDLDVVAFLASRRHAGTVALVDAATGRRVTFPELWRAVASAATALAAPPLSLRKGHVALILSPNSVHFPVAALAAMSLGAVITTANPLNTPAEIAKQVADARPVVAFTTRDLLPKLPAAGDGLRVVLLEPERLPSDPAAVVATIEEISATPPDPARRRDRVTQDDPATLLYSSGTTGPSKGVVATHRSLISMVQIIMTRFRLEGADRTEAFLCTVPMFHVYGLVAFATGLLGCGATIVVLSKYELPEMLRAINEYGVTYLPLVPPILVAMVAHPKPLPLGQLRKVLSGGAPLSKELIEGFREKYPQVEILQGYGLTESTAIGASTDSAEESRRYGTAGLLSPNTEAKIVDPETGEALPVNRTGELWIRGPYVMKGYFKNPEATQSTVTPDGWLKTGDLCYIDEDGYLFVVDRLKELIKYKGYQVPPAELEALLLTHPEIADVAVIPFPDREVGQFPMAYVVRKKGSKLSEREIMEFVAKQVAPYKKVRKVAFVAEIPKNASGKILRKDLIKLATSKL

SEQ ID NO: 3824 - protein, 547 aa, Pennisetum glaucum
MAPPPEADPRSGYCAATRSFRSKRAPVPLPADRDLDVVAFLASRRHAGTVALVDAATGRRVTFPDLWRAVAGAATALAAPPLSLRKGSVALILSPNSVHFPVAALAAMSLGAVVTTANPLNTPAEIAKQVADAGPVVAFTTRDLLPKLPAGLRVVVLLEPHRLPSDPAAVVATIDEISATTPDPARRKERVTQDDPATLLYSSGTTGPSKGVVATHRSLIAMVQIIMTRFRLEGADRTEAFLCTVPMFHVYGLVAFATGLLGCGATIVVLSKYELPEMLRAINEYGVTYLPLVPPILVAMVAHPKPLPLGQLRKVLSGGAPLSKELIEGFREKYPQVEILQGYGLTESTAIGASTDSAEESRRYGTAGLLSPNTEAKIVDPETGEALPVNRTGELWIRGPYVMKGYFKNPEATQSTVTPEGWLKTGDLCYIDEDGYLFVVDRLKELIKYKGYQVPPAELEALLLTHPEIADVAVIPFPDREVGQFPMAYVVRKKGSNLSEREVMEFVAKQVAPYKKVRKVAFVTEIPKNASGKILRKDLIKVATSKL

SEQ ID NO: 3825 - protein, 552 aa, Oryza sativa
MGRSPEMEVDARSGYCAATRTFRSRRADVPLPADPEVDVVSFLASRRHSGVVALVDAATGRRITFTELWRAVAGAASALAAHPVSLRKGHVALILSPNSVHFPVAALAAMSLGAVLTTANPLNTPAEIAKQVADARPVLAFTTRELLPKLPRAHDLRVVLLESARLPGDSSDPRIVATIEEISATTPDPARRKDRVTQDDPATLLYSSGTTGPSKGVVATHRSLISMVQIIMTRFRLEGSDKTETFLCTVPMFHVYGLVAFATGLLGCGATVVVLSKYELPEMLRSINAYGVTYLPLVPPILVAMVAHPKPLPLGQMRKVLSGGAPLGKELIEGFREKYPQVEILQGYGLTESTAIGASTDSAEESRRYGTAGLLSPNTEAKIVDPDSGEALPVNRTGELWIRGPYVMKGYFKNAEATQSTLTPDGWLKTGDLCYIDEDGYLFVVDRLKELIKYKGYQVPPAELEALLLTHPEVTDVAVIPFPDREVGQFPMAYIVRKKGSNLSEREVMEFVAKQVAPYKKVRKVAFVTDIPKNASGKILRKDLIKLATSKL

SEQ ID NO: 3826 - protein, 544 aa, Hordeum vulgare
MATATADPRSGYCAATGAFRSKRAVVPLPADRDLDVVTFLASRRHSGVVALVDASTGRRTTFADLWRAVAGAATALAAPPFGLRKGHVALILSPNSVHFPVAALAAMSLGAVVTTANPLNTAAEVAKQVADARPVLAFTTRDLLPKLPRGLRVVLLEPPSPADDPRIVATIDEISATTPDPARRRDRVTQDDQATLLYSSGTTGPSKGVVATHRNLISMVQIVMNRFRLEDSDTTETFLCTVPMFHVYGLVAFATGLLGCGATIVVLSKFELPEMLRCITAYGVTYLPLVPPILVAMVAHPKPLPLGNLRKVLSGGAPLSKELIEGFRDKYPQVEILQGYGLTESTAIGASTDSAEESRRYGTAGLLSPNTEAKIVDPETGEALPVNRTGELWIRGPYVMKGYFKNTEATQSTVTPDGWLKTGDLCYIDEDGYLFVVDRLKELIKYKGYQVPPAELEALLLTHPEVSDVAVIPFPDREVGQFPMAYVVRKKGSNLSAQEVMEFVAKQVAPYKKVRKVAFVTDIPKNASGKILRKDLIKLATSKL

SEQ ID NO: 3827 - protein, 553 aa, Secale cereale
MATAAAGVDPRSGYCAATGAFRSKRAAVPLPADRDLDVVTFLASRRHSGVVALVDASTGRRTTFADLWRAVAGAATALAAPPFGLRKGHVALILSPNSVHFPVAALAAMSLGAVVTTANPLNTAAEIAKQVADARPVLAFTTRDLLPKLPRAADGLRVVLLESSSPSPAGAADPRIVATIDEISATTPDPARRRDRVTQDDQATLLYSSGTTGPSKGVVATHRNLISMVQIVMNRFRLEDSDTTETFLCTVPMFHVYGLVAFATGLLGCGATIVVLSKFELPEMLRCISAYGVTYLPLVPPILVAMVAHPKPLPLGNLRKVLSGGAPLSKELIEGFREKYPQVEILQGYGLTESTAIGASTDSAEESRRYGTAGLLSPNTEAKIVDPETGEALPVNRTGELWIRGPYVMKGYFNNTDATQSTVTSDGWLKTGDLCYIDEDGYLFVVDRLKELIKYKGYQVPPAELEALLLTHPEVSDVAVIPFPDRDVGQFPMAYVVRKKGSNLSAQEVMEFVAKQVAPYKKVRKVAFVTDIPKNASGKILRKDLIKLATSKL

SEQ ID NO: 3828 - protein, 551 aa, Brachypodium distachyon
MAQSETADTRSGYCAATGSFRSKRAAVPLPVDRDVDVVTFLASRRHSGVVALIDAATGRRTTFGELWRAVAGAATALASAPFSLRKGHVALILSPNSVHFPVAALAAMSLGAVVTTANPLNTAAEIAKQVADARPVLAFTTRELLPKLPRDHPLRVVLLESAAGDPLPADPRIAATIEEISATPPDPARRRGDRVTQDDQATLLYSSGTTGPSKGVVSTHRNLISMVQIVMTRFRLEESDSTETFLCTVPMFHVYGLVAFATGLLGCGATIVVLSKFELPEMLRCINAYGVTYLPLVPPILVAMVAHPKPLPLGQLRKVLSGGAPLSKELIEGFKEKYPQVEILQGYGLTESTAIGASTDSAEESRQYGTAGLLSPNTEAKIVDPETAEALPVNRTGELWIKGPYVMKGYFKNTEATKATVTPEGWLKTGDLCYIDEDGYLFVVDRLKELIKYKGYQVPPAELEALLLTHPEITDAAVIPFPDKEVGQFPMAYIVRKNGSNLSAHEVMEFVAKQVAPYKKVRKVAFVTDIPKNASGKILRKDLIKLATSKL

SEQ ID NO: 3829 - protein, 581 aa, Setaria italica
MATAAAGPSPRRRLAAAVVAVALALALAPAAARPDKEMREKFYGTLVTNGTHNASGDGSIAEMFGRVLDKEFADSDTPDAPDKSNFNNSVSDHQAVLETVAVITHDKKKNDSQNTNSPKPFQIGDMFGGQDETSDDLETVIDKEDNVFVMSNRKTKYPTLQLDLRLIKDLVVIIVSATGGGIIFSCMGQPVIVGYLLAGSLVGPGGLNFISEMVQVETFAQFGVVFLLFALGLEFSLTKLKVVGPVAVLGGLLQIALFMFLCGLTAALCGAKSSEGVFVGAFLSMSSTAVVSKFLVEKGSTNTLHGQVTIGTLILQDCAVGLLFALLPVLGGASGIFGGVMSMAKLLLVLSIFIAVTYMMTWSIVPRFLKLMIQLSSQTNELYQLASVAFCLLLAWCSDYFGLSLELGSFLAGVMISTTDFAHHTLEQVEAIRNLFAALFLASIGMLIHVKFLWNHVDILLAAVILVIIVKSIVVTVVVKAFGYSIRTAFVVGLSLAQIGEFAFVLLSRASHLHLVGGKMYLLLLGTTALSLVTTPLIFKLIPVVMHLGILMRWFPTENSVQNELPLQEKAVMLEAHNRSL

SEQ ID NO: 3830 - protein, 584 aa, Zea mays
MAPAAAAAEAAGPSPRRRLAAAVLALALALACVLAQAAARPDKETREKFYGTLVANGTHNASGDGSIAEMFGRVLDKEFSDSDTPDAPDKSSFNNSVSDHQAVLETVAVITHDKKKNDSQHTNSPKPFQIGDMFGGQDETSDDLETVIDKEDNVFVMSNRKTKYPTLQLDLRLIKDLVIIIVSATGGGIMFSFMGQPVIVGYLLAGSLVGPGGLNFINEMVQVETFAQFGVVFLLFALGLEFSLTKLKVVGPVAVLGGLLQIVLFMFLCGLTAALCGAKSSEGVFVGAFLSMSSTAVVSKFLVEKGSTNTLHGQVTIGTLILQDCAVGLLFALLPVLGGASGIFGGVMSMAKLLLVLSVFVAVTYMMTWSIVPRFLKLMIQLSSQTNELYQLASVAFCLLLAWCSDYCGLSLELGSFLAGVMISTTDFAHHTMEQVEAIRNLFAALFLASIGMLIHVKFLWNHVDILLAAVILVIIVKSIVVAIVVKAFGYSMRTAFVVGLSLAQIGEFAFVLLSRASHLHLVGGKMYLLLLGTTALSLVTTPLIFKLIPVVMHLGILMRWFPSENSMQSEEKAVMLEAHNRSL

SEQ ID NO: 3831 - protein, 587 aa, Oryza sativa
MAPAAAGRVPLSRRRSTAALLLVALALVLGVQLRSAAARPDKEMREKFYGKLVTNGSGNATGDGSIAEMFGRVLDKEFSDSDTPEAPDKSSFNNSISDHQAVLETVAVITHDKKKNDSEQANSSKPFQIGDMFGGQNENSDDLETVIDKEDNVFVMSNRKTKYPTLQLDLRLIKDLVVIIVSATAGGIIFSCLGQPVIVGYLLAGSLVGPGGLNFISEMVQVETFAQFGVVFLLFALGLEFSLTKLKAVGPVAVIGGLLQIVLFMFLCGLTAALCGAKSSEGVFVGAFLSMSSTAVVSKFLVEKGSTNALHGQVTIGTLILQDCAVGLLFALLPVLGGASGIFGGVMSMAKLLLVLSVFITVAYMMTWSFVPRFLKLMIQLSSQTNELYQLASVAFCLLLAWCSDYLGLSLELGSFLAGVMISTTDFAHHTLEQVEPIRNLFAALFLASIGMLIHVKFLWNHVDILLAAVILVIIVKSVVVTVVVKAFGYSIRTAFVVGLSLAQIGEFAFVLLSRASHLHLVGGKMYLLLLGTTALSLVTTPLIFKLIPVVMHLGILMRWFPSESSMQNELPLQDKATMLEAYNRSL

SEQ ID NO: 3832 - protein, 861 aa, Brachypodium distachyon
MAGAGAGAGIGASAKSSTGISKLSTVSTHNGTSSNTVAATLDFLTPVSSDTSSPRATTVTLYSPAAVDASVRSGLAPALTSFSDGLGSYAGTAWYISSRTRSSFSIFPTSGVPALATNASSLGANSVSPVAMAAWYALSTPGFPATSAANRLHPAFSSSLVKFAASGTSKSPSNSMGAEISSTAKSYGVCFTAFTSVASNLAPLLADANPKSPLSSLAILTVPMASPAAWKKVSERRDVVLNPAAAAAAAHHWRRQATQEQHYYARSDDRPLARHAPIRMAHGGSSSSPPSRRRFTAAVFAVAVALALAPQLRPAAGRPDKETREKFYGRLVTNGTHNASAEDSIADMFGRVLEKEFSDSDTNETPDKNSFNNSISDHQAVLETVAVITHDRKNDSQLANSSRPFQIGDMFGGQNENSDETETVIDKEDNVFVMSNRKTKYPTLQLDLRLIKDLVVIIVSATGGGIIFSCLGQPVIVGYLLAGSLIGPGGLNLISEMVQVETFAQFGVVFLLFALGLEFSLPKLKAVGPVAVVGGLLQIALFMFLCGLTAVLCGAKTSEGVFVGTFLSMSSTAVVSKFLVEKGSTNALHGQVTIGTLILQDCAVGLLFALIPVLGGSSSLFGGMMSIGKLLLVLSIFVTVAYMMTWSFVPRFLKLMIQLSSQTNELYQLAAVAFCLLLAWCSDYLGLSLELGSFLAGVMISTTDFAHHTLEQVEAIRNLFAALFLASIGMLIHFKFLWNHVDILLAAVILVIIVKSLVITVVIKAFGYNIRTAFVVGLSLAQIGEFAFVLLSRASHLHLIGGKMYLLLLGTTALSLVTTPLIFKLIPVVMQLGILMRWFPSESNVHNEEKVTMLEVHNRTL

SEQ ID NO: 3833 - protein, 544 aa, Triticum aestivum
PDKETREKFYGSLVANGTHNATAGDNSIADMFGRVLDKEFSDSDASEVPDKNSFNNSISDHQAVLETVAVITHDKKNDTQQANSSRPFQIGDMFGSQNENSDDTETVIDKEDNVFVMSNRKTKYPTLQLDLRLIKDLVVIIVSATAGGIIFSCLGQPVIVGYLLAGSLIGPGGLNLINEMVQVETFAQFGVVFLLFALGLEFSLPKLKVVGPVAVLGGVLQIALFMFLCGLTAALCGAKLSEGVFVGTFLSMSSTAVVSKFLVEKGITNALHGQVTIGTLILQDCAVGLLFALIPVLGGSSGIFGGMMSMGRLLLVLSIFVTVAYMMTWSFIPRFLKLMIQLSSQTNELYQLAAVAFCLLLAWCSDYLGLSLELGSFLAGVMISTTDFAHHTLEQVEAIRNLFAALFLASIGMLIHFKFLWNHVDILLAAVILVIIVKSIVITAVIKSFGYSIRTAFIVGLSLAQIGEFAFVLLSRASHHHLIGGKMYLLLLGTTALSLVTTPLIFKLIPVVTQLGILMRWFPSESGVQNEEKATMLDVYNRTL

SEQ ID NO: 3834 - protein, 474 aa, Zea mays
MAPPPTSRCLALALILIGALCAAAAAARFAPADNHLLACGAAAPAVLPDGRRFVPDSGCASTRLRSSSPSLSSAAPPGSPPPPSSLLASARVFSCRASYDLDVRRRGHHILRLHFYPFVPALAAARFHVGAGGLLLLHNFTASSPVVKEFILPVDSDVLVLTFVPDSGSTAFVNAIELVSAPEELVGDIGTLVTSGGAAQIHELSSQVFETLYRINVAGRKVTPFNDTLWRTWVNDEKFLIDTDSSNYMVWSSSGRIAYPKGSKQMTREVAPDNVYNSARSVRPGVNVTWGFPVPASSRYLVRMHFCDIASKALYELYFNIYVNGDLAVKDFDLSSATGFLAYPYYIDFIVDVKDEGILKLAIGGLKKSRSDEVSGILNALEIMRMNKTSGGMDGDFPIDLHMEYVVSKGIGEFARSLLCGFIFVGLFVALVTLMVRLRTELRNNGTAWSWRQMNSDEGKLARTYQLVPSKTDY

SEQ ID NO: 3835 - protein, 474 aa, Panicum virgatum
MASPPTACRLAVLLLGVLCSATAVAAARYAPADNHLLACGAEAPAVLPDGRRFVPDSGCASTRLRSPAPTLSSAAPPGSTPPPSPLHASARVFSCRASYDLAVRRRGHHILRLHFYPFGPALSASRFHVGAGGLLLLHNFTASSPVVKEFILPVDSDVVVLTFVPDSGSTAFINAIELLSAPEEIVGDIGTLVTSGGAAQIDGLSSQVFETLYRITIAGRKVTPFNDTLWRTWVNDADFLVGTDSANYKVWSFSGRIAYPKGSRQMTREVAPDNVYSSARSVKPGANVTWGFPVPAGSRYLVRMHFCDIVSKALYELYFNIYINGNLAVKDFDLSSSTGFLAYPYYIDFIVDVEGEGMLKLAIGGLKQSRSDEVSGILNALEIMRMNKTSGGMDGNFPIALDMEYGVSKGIGEFARSLLCGFIFAGLFVALVMLVLRLRTELRNNGTAWSWKPMDSGEGKLAKAYQLVPSKADY

SEQ ID NO: 3836 - protein, 474 aa, Panicum virgatum
MASPPTPRRLAVLLLGVLCSAAAVAAARYAPADNHLLACGAEAPAVLPDGRRFVPDSGCASTRLRSPAPTLSSAAPPGSPPPPSPLHASARVFSCRASYDLAVRRRGHHILRLHFYPFAPALSASRFHVGAGGLLLLHNFTASSPVVKEFILPVDSDVVVLTFVPDSGSTAFINAIELLSAPEEIVGDIGTLVTSGGAAQIDGLSSQVFETLYRITVAGRKVTPFNDTLWRTWVNDADFLVGTDSTNYKVWSFSGRIAYPKGSRQMTREVAPDNVYSSARSVKPGANVTWGFPVPAGSRYLVRMHFCDIVSKALYELYFNIYVNGNLAVKNFDLSSTTGFLAYPYYIDFIVDVEGEGMLKLAIGGLKQSRSDEVSGILNALEIMRMNKTSGGMDGNFPIALDVEYGVSKGIGEFALSLLCGFIFAGLFVTLVMLVLRLRTELRNNGTAWSWKPMDSGEGKLAKAYQLVPSKADY

SEQ ID NO: 3837 - protein, 474 aa, Panicum virgatum
MASPPTPRRLAVLLLGVLCSAAAVAAARYAPVDNHLLACGAEAPAVLPDGRRFVPDSGCASTRLRSPAPTLSYAAPPGSPPPPSPLHASARVFSCRASYDLAVRRRGHHILRLHFYPFAPALSASRFHVGAGGLLLLHNFTASSPVVKEFILPVDSDIIVLTFVPDSASTAFINAIELVSAPEEIVGDIGTLVTSAGAAQIDGLSSQVFETLYRITVAGRKVTPFNDTLWRTWVNDADFLVGTDSTNYKVWSFSGRIAYPRGSRQMTREVAPDNVYSSARSVKPGANVTWGFPVPAGSRYLVRMHFCDIVSKALYELYFNIYVNGNLAVKNFDLSSTTGFLAYPYYIDFIVDVEGEGMLKLAIGGLKQSRSDEVSGILNALEIMRMNKTSGGMDGNFPIALDVEYGVSKGIGEFALSLLCGFIFAGLFVTLVMLVLRLRTELRNNGTAWSWKPMDSGEGKLAKAYQLVPSKADY

SEQ ID NO: 3838 - protein, 474 aa, Setaria italica
MVPPPTPRRIAVLLLGFLCSAAAVAAARYAPADNHLLACGAEAPALLPDGRRFVPDSGCASTRLRSPAATLASAAPPGSPPPPSPLHASARVFSCRASYDLAVRRRGHHILRLHFYPFGPALSVSRFHVGAGGLLLLHNFTASSPVVKEFVLPVDTDILVLTFVPESDSTAFINAIELVSAPEELVGDIGTLVTSGGAAQIDGLSSQVFETLYRITVAGRKVTPFNDTLWRTWVNDGKFLVNTDSTNYKVWSFSGRIAYPKGSRQMTRELAPDNVYSSARSVRPGANLTWVFPVPAGSRYLVRMHFCDIVSKALYQLYFNIYVNGNLAVKDFDLSSTTGFLAYPYYIDFIVDVEDEGMLKLAIGGLKQSRSDEVSGILNALEIMRMNKTSGGMDGNFPIALDTEYGVSKGIGEFARSLLCGFIFAGLFVALVMLVLRLRTELRNNSTAWSWKPMDSGEGKLAKAYQLVPSKTDY

SEQ ID NO: 3839 - protein, 535 aa, Zea mays
MALAFDEFGRPFIILREQEKKTRLRGLDAQKANIGAGKAVARILRTSLGPKGADKMLQSPDGDVIITNDGATILEQMDVDNQIAKLMVELSRSQDYEIGDGTTGVVVMAGALLEQAEKLLERGIHPIRVAEGYEMASKVAFDHLERISEKFEFSADNIEPLVQTCMTTLSSKIVNRCKRALAEIAVKAVLAVADLERKDVNLDLIKVEGKVGGKLEDTELVYGIIVDKDMSHPQMPKRIEDAKIAILTCPFEPPKPKTKHKVDIDTVEKFQTLREQEQKYFDEMVQKCKDAGATLVICQWGFDDEANHLLMHRNLPAVRWVGGVELELIAIATGGRIVPRFQELSPEKLGKAGLVREKSFGTTKDRMLYIEQCANSRAVTIFIRGGNKMMIEETKRSLHDALCVARNLIRNNSIVYGGGSAEISCSIAVETAADRHPGVEQYAIRSFADALDAVPLALAENSGLSPIDTLTAVKAQQVKESNPHCGIDCNDVGTNDMKEQNVFETLIGKQQQILLATQVVKMILKIDDVISPSEY

SEQ ID NO: 3840 - protein, 535 aa, Zea mays
MALAFDEFGRPFIILREQEKKTRLRGLDAQKANIASAKAVARILRTSLGPKGMDKMLQSPDGDVIITNDGATILEQMDVDNQIAKLMVELSRSQDYEIGDGTTGVVVMAGALLEQAEKLLERGIHPIRVAEGYEMASKVAFDHLEHISEKFEFSADNIEPLVQTCMTTLSSKIVNRCKRALAEIAVKAVLAVADLERKDVNLDLIKVEGKVGGKLEDTELVYGIIVDKDMSHPQMPKRIEDAKIAILTCPFEPPKPKTKHKVDIDTVEKFQTLREQEQKYFDEMVQKCKDAGATLVICQWGFDDEANHLLMHRNLPAVRWVGGVELELIAIATGGRIVPRFQELSPEKLGKAGLVREKSFGTTKDRMLYIEKCANSRAVTIFIRGGNKMMIEETKRSLHDALCVARNLIRNNSIVYGGGSAEISCSIAVETAADRHPGVEQYAIRSFADALDAVPLALAENSGLSPIDTLTAVKAQQVKESNPHCGIDCNDVGTTDMKEQNVFETLIGKQQQILLATQVVKMILKIDDVISPSEY

SEQ ID NO: 3841 - protein, 535 aa, Panicum virgatum
MALAFDEFGRPFIILREQEKKTRLRGLDAQKANIASGKAVSRILRTSLGPKGMDKMLQSPDGDVTITNDGATILEQMDVDNQIAKLMVELSRSQDYEIGDGTTGVVVMAGALLEQAEKLLERGIHPIRVAEGYEMASRIAFDHLERISQKFEFSADNIEPLVQTCMTTLSSKIVNRCKRALAEIAVKAVLAVADLERKDVNLDLIKVEGKVGGKLEDTELIYGIVVDKDMSHPQMPKRIEDAKIAILTCPFEPPKPKTKHKVDIDTVEKFQTLREQEQKYFDEMVQKCKDVGATLVICQWGFDDEANHLLMHRNLPAVRWVGGVELELIAIATGGRIVPRFQELSPEKLGKAGLVREKSFGTTKDRMLYIEQCANSRAVTIFIRGGNKMMIEETKRSLHDALCVARNLIRNNSIVYGGGSAEISCSIAVETAADRHPGVEQYAIRSFADALDAVPLALAENSGLPPIDTLTAVKAQQVKESNPHCGIDCNDVGTNDMKEQNVFETLIGKQQQILLATQVVKMILKIDDVISPSEY

SEQ ID NO: 3842 - protein, 535 aa, Panicum virgatum
MALAFDEFGRPFIILREQEKKTRLRGLDAQKANNASGKAVSRILRTSLGPKGMDKMLQSPDGDVTITNDGATILEQMDVDNQIAKLMVELSRSQDYEIGDGTTGVVVMAGALLEQAEKLLERGIHPIRVAEGYEMASRIAFDHLERISQKFEFSADNIEPLVQTCMTTLSSKIVNRCKRALAEIAVKAVLAVADLERKDVNLDLIKVEGKVGGKLEDTELIYGIVVDKDMSHPQMPKRIEDAKIAILTCPFEPPKPKTKHKVDIDTVEKFQTLREQEQKYFDEMVQKCKDVGATLVICQWGFDDEANHLLMHRNLPAVRWVGGVELELIAIATGGRIVPRFQELSPEKLGKAGLVREKSFGTTKDRMLYIEQCANSRAVTIFIRGGNKMMIEETKRSLHDALCVARNLIRNNSIVYGGGSAEISCSIAVETAADRHPGVEQYAIRSFADALDAVPLALAENSGLPPIDTLTAVKAQQVKESNPHCGIDCNDVGTNDMKEQNVFETLIGKQQQILLATQVVKMILKIDDVISPSEY

SEQ ID NO: 3843 - protein, 535 aa, Cenchrus ciliaris
MALAFDEFGRPFIILREQEKKTRLRGLDAQKANIASGKAVARILRTSLGPKGMDKMLQSPDGDVTITNDGATILEQMDVDNQIAKLMVELSRSQDYEIGDGTTGVVVMAGALLEQAEKLLERGIHPIRVAEGYEMASRIAFDHLERISQKFEFSADNIEPLVQTCMTTLSSKIVNRCKRALAEIAVKAVLAVADLERKDVNLDLIKVEGKVGEKLEDTELIYGIVVDKDMSHPQMPKRIEDAKIAILTCPFEPPKPKTKHKVDIDTVEKFQTLREQEQKYFDEMVQKCKDAGATLVICQWGFDDEANHLLMNRNLPAVRWVGGVELELIAIATGGRIVPRFQELSPEKLGKAGLVREKSFGTTKDRMLYIEQCANSRAVTIFIRGGNKMMIEETKRSLHDALCVARNLIRNNSIVYGGGSAEISCSIAVETAADRHPGVEQYAIRSFADALDAVPLALAENSGLPPIDTLTAVKAQQVKESNAHCGIDCNDVGTNDMKEQNVFETLIGKQQQILLATQVVKMILKIDDVISPSEY

SEQ ID NO: 3844 - protein, 535 aa, Sorghum bicolor
MALAFDEFGRPFIILREQEKKTRLRGLDAQKANIAAGKAVARILRTSLGPKGMDKMLQSPDGDVTITNDGATILEQMDVDNQIAKLMVELSRSQDYEIGDGTTGVVVMAGALLEQAEKLLERGIHPIRVAEGYEMASRVAFDHLERISQKFEFNADNIEPLVQTCMTTLSSKIVHRCKRALAEIAVKAVLAVADLGRKDVNLDLIKVEGKVGGKLEDTELIYGIVVDKDMSHPQMPKRIEDAKIAILTCPFEPPKPKTKHKVDIDTVEKFQTLREQEQKYFDEMVQKCKDVGATLVICQWGFDDEANHLLMHRNLPAVRWVGGVELELIAIATGGRIVPRFQELSPEKLGKAGLVREKSFGTTKDRMLYIEQCANSRAVTIFIRGGNKMMIEETKRSLHDALCVARNLIRNNSIVYGGGSAEISCSIAVETAADRHPGVEQYAIRSFADALDAVPLALAENSGLPPIDTLTVVKAQQVKDSNPHCGIDCNDVGTNDMKEQNVFETLIGKQQQILLATQVVKMILKIDDVISPSEY

SEQ ID NO: 3845 - protein, 535 aa, Setaria italica
MALAFDEFGRPFIILREQEKKTRLRGLDAQKANIAAGKAVARILRTSLGPKGMDKMLQSPDGDVTITNDGATILEQMDVDNQIAKLMVELSRSQDYEIGDGTTGVVVMAGALLEQAEKLLERGIHPIRVAEGYEMASRIAFDHLEHISRKFEFSADNIEPLVQTCMTTLSSKIVNRCKRALAEIAVKAVLAVADLERKDVNLDLIKVEGKVGGKLEDTELIHGIVVDKDMSHPQMPKRIEDAKIAILTCPFEPPKPKTKHKVDIDTVEKFQTLREQEQKYFDEMVQKCKDAGATLVICQWGFDDEANHLLMHRNLPAVRWVGGVELELIAIATGGRIVPRFQELSPEKLGKAGLVREKSFGTTKDRMLYIEQCANSRAVTIFIRGGNKMMIEETKRSLHDALCVARNLIRNNSIVYGGGSAEISCSIAVETAADRHPGVEQYAIRSFADALDAVPLALAENSGLPPIDTLTVVKAQQVKESNPHCGIDCNDVGTNDMKEQDVFETLIGKQQQILLATQVVKMILKIDDVISPSEY

SEQ ID NO: 3846 - protein, 535 aa, Panicum virgatum
MALAFDEFGRPFIILREQEKKTRLRGLDAQKANIAAGKAVARILRTSLGPKGMDKMLQSPDGDVTITNDGATILEQMDVDNQIAKLMVELSRSQDYEIGDGTTGVVVMAGALLEQAEKLLERGIHPIRVAEGYEMASRIAFEHLERISQKFEFSADNIEPLVQTCMTTLSSKFVNRCKRALAEIAVKAVLAVADLERKDVNLDLIKVEGKVGGKLEDTELIYGVVVDKDMSHPQMPKRIEDAKIAILTCPFEPPKPKTKHKVDIDTVEKFQTLREQEQKYFDEMVQKCKDVGATLVICQWGFDDEANHLLMHRNLPAVRWVGGVELELIAIATGGRIVPRFQELSLEKLGKAGLVREKSFGTTKDRMLYIEQCANSRAVTIFIRGGNKMMIEETKRSLHDALCVARNLIRNNSIVYGGGSAEISCSIAVETAADRHPGVEQYAIRSFADALDAVPLALAENSGLPPIDTLTAVKAQQVKESNPHCGIDCNDVGTNDMKEQNVFETLIGKQQQMLLATQVVKMILKIDDVISPSEY

SEQ ID NO: 3847 - protein, 535 aa, Setaria italica
MALAFDEFGRPFIILREQEQKTRLRGLDAQKANIAAGKAVARILRTSLGPKGMDKMLQSPDGDVTITNDGATILEQMDVDNQIAKLMVELSRSQDYEIGDGTTGVVVMAGALLEQAEKLLERGIHPIRVAEGYEMASRIASEHLERISHKYEFTADNIEPLVQTCMTTLSSKIVNRCKRALAEIAVKAVLAVADLERKDVNLDLIKVEGKVGGKLEDTELIYGIVVDKDMSHPQMPKRIEDAKIAILTCPFEPPKPKTKHKVDIDTVEKFQTLREQEQKYFDEMVQKCKDAGATLVICQWGFDDEANHLLMNRNLPAVRWVGGVELELIAIATGGRIVPRFEELSPEKLGKAGLVREKSFGTTKDRMLYIEQCANSRAVTIFIRGGNKMMIEETKRSLHDALCVARNLIRNNSIVYGGGSAEISCSIAVETAADRHPGVEQYAIRSFADALDAVPLALAENSGLPPIDTLTAVKAQQVKESNPHCGIDCNDVGTNDMKEQNVFETLIGKQQQILLATQVVKMILKIDDVISPSEY

SEQ ID NO: 3848 - protein, 535 aa, Pennisetum glaucum
MALAFDEFGRPFIILREQEKKTRLRGLDAQKANIAAGKAVARILRTSLGPKGMDKMLQSPDGDVTITNDGATILEQMDVDNQIAKLMVELSRSQDYEIGDGTTGVVVMAGALLEQAEKLLERGIHPIRVAEGYEMASRIAFEHLERISHKFEFTADNIEPLVQTCMTTLSSKIVNRCKRALAQIAVKAVLAVADLERKDVNLDLIKVEGKVGGKLEDTELIYGIVVDKDMSHPQMPKRIEDAKIAILTCPFEPPKPKTKHKVDIDTVEKFQTLREQEQKYFDEMVQKCKDAGATLVICQWGFDDEANHLLMNRNLPAVRWVGGVELELIAIATGGRIVPRFQELTPEKLGKAGLVREKSFGTTKDRMLYIEQCANSRAVTIFIRGGNKMMIEETKRSLHDALCVARNLIRNNSIVYGGGSAEISCSIAVETAADRHPGVEQYAIRSFADALDAVPLALAENSGLPPIDTLTAVKAQQVKESNPHYGIDCNDVGTNNMKEQNVFETLIGKQQQILLATQVVKMILKIDDVISPSEY

SEQ ID NO: 3849 - protein, 535 aa, Panicum virgatum
MALAFDEFGRPFIILREQEKKTRLRGLDAQKANIAAGKAVARILRTSLGPKGMDKMLQSPDGDVTITNDGATILEQMDVDNQIAKLMVELSCSQDYEIGDGTTGVVVMAGALLEQAEKLLERGIHPLRVAEGYEMASRIAFDHLERISQKFEFSADNIEPLVQTCMTTLSSKIVNRCKRALAEIAVKAVLAVADLERKDVNLDLIKVEGKVGGKLEDTELIYGIVVDKDMSHPQMPKRIEDAKIAILTCPFEPPKPKTKHKVDIDTVQKFQTLRDQEQKYFDEMVQKCKDVGATLVICQWGFDDEANHLLMHRNLPAVRWVGGVELELIAIATGGRIVPRFQELSPEKLGKAGLVREKSFGTTKDRMLYIEQCANSRAVTIFIRGGNKMMIEETKRSLHDALCVARNLIRNNSIVYGGGSVEISCSIAVETAADRHPGVEQYAIRSFADALEAVPLALAENSGLPPIDTLTAVKAQQVKESNPHCGIDCNDVGMNDMKEQNVFETLIGKQQQILLATQVVKMILKIDDVISPSEY

SEQ ID NO: 3850 - protein, 535 aa, Oryza sativa
MALAFDEFGRPFIILREQEKKSRLRGLDAQKANIAAGKAVARILRTSLGPKGMDKMLQSPDGDVTITNDGATILEQMDVDNQIAKLMVELSCSQDYEIGDGTTGVVVMAGSLLEQAEKLLERGIHPIRIAEGYELASRIAFDHLEHISHKFEFSATNIEPLVQTCMTTLSSKIVNRCKRTLAEIAVKAVLAVADLERKDVNLDLIKVEGKVGGKLEDTELVYGIIVDKDMSHPQMPKRIEDAKIAILTCPFEPPKPKTKHKVDIDTVEKFQMLREQEQKYFDEMVQKCKDVGATLVICQWGFDDEANHLLMHRNLPAVRWVGGVELELIAIATGGRIVPRFQELSPEKLGKAGIVREKSFGTTKDRMLYIEQCANSRAVTIFIRGGNKMMIEETKRSLHDALCVARNLIRNNSIVYGGGSAEISCSVAVEAAADRYPGVEQYAIRSFADALDAIPLALAENSGLSPIDTLTAVKSQQVKESNPHCGIDCNDVGTNHMKEQNVFETLIGKQQQILLATQVVKMILKIDDVISPSDY

SEQ ID NO: 3851 - protein, 535 aa, Brachypodium distachyon
MALAFDEFGRPFIILREQEKKSRLQGLDAQKANIAAGKSVARILRTSLGPKGMDKMLQSPDGDVTITNDGATILELMDVDNQIAKLMVELSRSQDYDIGDGTTGVVVMAGSLLEQAEKLLERGIHPIRVAEGYEMASRIAFDHLERISTKFEFSATDIEPLVQTCMTTLSSKIVSRCKRALAEIAVKAVLAVADLERKDVNLDLIKVEGKVGGKLEDTELVHGIIVDKDMSHPQMPKRIEDAHIAILTCPFEPPKPKTKHKVDIDTVEKFQTLRGQEQKYFDEMVQKCKDVGATLVICQWGFDDEANHLLMHRNLPAVRWVGGVELELIAIATGGRIVPRFQELSTEKLGKAGLVREKSFGTTKDRMLYIEKCANSRAVTIFIRGGNKMMIEETKRSLHDALCVARNLIINNSIVYGGGSAEISCSIAVEAAADRHAGVEQYAIRSFADALDAIPLALAENSGLPPIDTLTVVKSQHVKESNPHCGIDCNDVGTNDMKEQNVFETLIGKQQQILLATQVVKMILKIDDVITPSEY

SEQ ID NO: 3852 - protein, 535 aa, Brachypodium distachyon
MVLVFDEFGRRFIILREQESKSRLRGLDAHKANVAGGKAVARILRTSLGPKGMDKMLQSPDGDVTITNDGATILEQMDVDNQIAKLMVELSRSQDYEIGDGTTGVVVMAGSLLEQAEKLLERGIHPIRIAEGYEMASRIAFDHLEHISNKFEFTATNIEPLVQTCMTTLSSKIVNRCKRMLAEIAVKAVLAVADLERKDVNLDLIKVEGKVGGKLEDTELIYGIAVDKDMSHPQMPKRIEDANIAILTCPFEPPKPKTKHKVDIDTVEKFQTLREQEQKYFDEMVQKCKDVGATLVICQWGFDDEANHLLMHRNLPAVRWVGGVELELIAIATGGRIVPRFQELSPEKLGKAGLVREKSFGTTKDRMLYIEKCANSRAVTIFIRGGNKMMIEEAKRSIHDALCVARNLIRNNSIVYGGGSAEISCSIAVDAAADRYAGVEQYAIRSFADALDGIPLALAENSGLPPIDTLTAVKSQQVKEGNPHCGIDCNDVGTNDMREQNVFETLIGKQQQLLLATQVVKMILKIDDVITPSEF

SEQ ID NO: 3853 - protein, 523 aa, Panicum virgatum
GTGPDRSGSHRFGQPCAQKANIAAGKAVARILRTSLGPKGMDKMLQSPDGDVTITNDGATILEQMDVDNQIAKLMVELSRSQDYEIGDGTTGVVVMAGALLEQAEKLLERGIHPIRVAEGYEMASRIAFDHLERISQKFEFSGDNIEPLVQTCMTTLSSKIVNRCKRALAEIAVKAVLAVADLERKDVNLDLIKVEGKVGGKLEDTELIYGIVVDKDMSHPQMPKRIEDAKIAILTCPFEPLKPKTKHKVDIDTVEKFQTLREQEQKYFDEMVQKCKDVGATLVICQWGFDDEANHLLMHRNLPAVRWVGGVELELIAIATGGRIVPRFQELSSEKLGKAGLVREKSFGTTKDRMLYIEKCANSRAVTIFIRGGNKMMIEETKRSLHDALCVARNLIRNNSIVYGGGSAEISCSIAVETAADRHPGVEQYAIRSFADALDAVPLALAENSGLPPIDTLTAVKAQQVKESNPHCGIDCNDVGTNDMKEQNAFETLIGKQQQILLATQVVKMILKIDDVISPSDY

SEQ ID NO: 3854 - protein, 535 aa, Fragaria vesca
MALAFDEFGRPFIILREQEQKSRLRGLDAQKANIAAGKAVGKILRTSLGPKGMDKMLQSPDGEVTVTNDGATILEQMDVDNQIAKLMVELSRSQDYEIGDGTTGVVVLASSLLEQAERLLERGIHPIRVAEGYEMASRIAFDHLQHISKKFEFGVENIEPLVQTCMTTLSSKIVNRCKRSLAEIAVKAVLAVADLERKDVNLDLIKVEGKVGGKLEDTELVYGILIDKDMSHPQMPKRIEDAKIAILTCPFEPPKPKTKHKVDIDTVEKFQTLRVQEQEYFDQMVQKCKDAGATLVICQWGFDDEANHLLMHRNLPAVRWVGGVELELIAIATGGRIVPRFQELTPDKLGKAGLVREKSFGTTKDRMLYIEHCANSRAVTIFIRGGNKMMIEETKRSIHDALCVARNLIRNNSIVYGGGSAEISCSVAVEAAADKHPGVEQYAIRAFADALDAVPMALAENSGLQPIETLNAVKSQQIKEKNPHCGIDCNDVGTNDMREQNVFETLIGKQQQILLATQVVKMILKIDDVISPSEY

SEQ ID NO: 3855 - protein, 535 aa, Avena sativa
MALDFDEYWRPFIILREQEKKSRLQGLDAQKANIAAGKSVARILRTSLGPKGMDKMLQSPDGDVTITNDGATILELMDVDNQIAKLMVELSRSQDYDIGDGTTGVVVMAGSLLEQAEKLLERGIHPIRVAEGYEMASRIAVDHLESISTKYEFSATDIEPLVQTCMTTLSSKIVSRCKRALAEIAVKAVLAVADLERKDVNLDLIKVEGKVGGKLEDTELVQGIIVDKDMSHPQMPKRIEDAHIAILTCPFEPPKPKTKHKVDIDTVEKFQTLRGQEQKYFDEMVQKCKDVGATLVICQWGFDDEANHLLMQRELPAVRWVGGVELELIAIATGGRIVPRFQELSTEKLGKAGLVREKSFGTTKDRMLYIEKCANSKAVTIFIRGGNKMMIEETKRSIHDALCVARNLIINNSIVYGGGSAEISCSIAVEAAADRHPGVEQYAIRAFADALDAIPLALAENSGLPPIDTLTVVKSQHVKENNSRCGIDCNDVGTNDMKEQNVFETLIGKQQQILLATQVVKMILKIDDVITPSEY

SEQ ID NO: 3856 - protein, 535 aa, Solanum tuberosum
MALAFDEFGRPFIILREQEQKTRLRGLDAQKANISAGKAVARILRTSLGPKGMDKMLQSPDGDVTITNDGATILEQMDVDNQIGKLMVELSRSQDYEIGDGTTGVVVMAGALLEQAEKLLERGIHPIRIAEGYEMASRIAVEHLERVAHKFEFGLNDIEPLVQTCMTTLSSKIVNRCKRSMAEIAVKAVLAVADLERKDVNLDLIKVEGKVGGKLEDTELIYGIIVDKDMSHPQMPKQIEDAKIAILTCPFEPPKPKTKHKVDIDTVEKFQTLRLQEQKYFDDMVQKCKDVGATLVICQWGFDDEANHLLMHRNLPAVRWVGGVELELIAIATGGRIVPRFQELTPEKLGKAGIVREKAFGTTKDRMIYIEHCANSRAVTIFIRGGNKMMIEETKRSIHDALCVARNLIRNNSIVYGGGSAEISCSIAVEAAADKHPGVEQYAIRAFADALDSVPMALAENSGLQPIETLSAVKSQQIKENNPCCGIDCNDVGTNDMREQNVFETLIGKQQQILLATQVVKMILKIDDVITPSAY

SEQ ID NO: 3857 - protein, 535 aa, Solanum lycopersicum
MALAFDEFGRPFIILREQEQKTRLRGLDAQKANISAGKAVARILRTSLGPKGMDKMLQSPDGDVTITNDGATILEQMDVDNQIGKLMVELSRSQDYEIGDGTTGVVVMAGALLEQAEKLLERGIHPIRIAEGYEMASRIAVEHLERVAHKFEFGQNDVEPLVQTCMTTLSSKIVNRCKRSMAEIAVKAVLAVADLERKDVNLDLIKVEGKVGGKLEDTELIYGIIVDKDMSHPQMPKQIEDAKIAILTCPFEPPKPKTKHKVDIDTVEKFQTLRLQEQKYFDDMVQKCKDVGATLVICQWGFDDEANHLLMHRNLPAVRWVGGVELELIAIATGGRIVPRFQELTPEKLGKAGIVREKSFGTTKDRMIYIEHCANSRAVTIFIRGGNKMMIEETKRSIHDALCVARNLIRNNSIVYGGGSAEISCSIAVEAAADKHPGVEQYAIRAFADALDAVPMALAENSGLQPIETLSAVKSQQIKENNPCCGIDCNDVGTNDMREQNVFETLIGKQQQILLATQVVKMILKIDDVITPSEY

SEQ ID NO: 3858 - protein, 535 aa, Liriodendron tulipifera
  misc_feature (456)..(456): Xaa can be any naturally occurring amino acid
  misc_feature (514)..(514): Xaa can be any naturally occurring amino acid
MALAFDDFGRPFIIIKEQEQKSRLRGLDAQKANISAGKAVARILRTSLGPKGMDKMLQSPDGEVTITNDGATILEQMDVDNQIAKLMVELSRSQDYEIGDGTTGVVVVAGALLEQAERLLERGIHPIRIAEGYETASRIAVEHLEHISQKFDFSLSNIESLVQTCMTTLSSKIVNRCKRTLAEIAVKAVMAVADLERKDVNLDLIKVEGKVGGKLEDTELIYGIVVDKDMSHPQMPKRIEDAKIAILTCPFEPPKPKTKHKVDIDTVEKFQTLRQQEQKYFDDMVQKCKDVGATLVICQWGFDDEANHLLMHRNLPAVRWVGGVELELIAIATGGRIVPRFQELTPEKLGKAGLVREKSFGTTKDRMLYIEQCANSRAVTIFIRGGNKMIIEETKRSIHDALCVARNLIRNNSIVYGGGSAEISCSIAVETAADRYPGVEQYAIRAFADALDAIPXALAENSGLQPIDTLTAVKAQQIKESNPHCGIDCNDVGTNDMREQNVFETLIGKQQQMXLATQVVKMILKIDDVIAPSDY

SEQ ID NO: 3859 - protein, 535 aa, Avena sativa
MALAFDEYGRPFIILREQEKKSRLQGLDAHKANIAAAKAIARILRTSLGPKGMDKMLQSPDGDVTITNDGATILELMDVDNQIAKLLVELSRSQDYDIGDGTTGVVVMAGALLEQAEKLLERGIHPIRVAEGYEMASRIAVDHLESISTKYEFSATDIEPLVQTCMTTLSSKIVSRCKRALAEISVKAVLAVADLERKDVNLDLIKVEGKVGGKLEDTELVQGIIVDKDMSHPQMPKRIEDAHIAILTCPFEPPKPKTKHKVDIDTVEKFQTLRGQEQKYFDEMVQKCKDVGATLVICQWGFDDEANHLLMQRELPAVRWVGGVELELIAIATGGRIVPRFQELSTEKLGKAGLVREKSFGTTKDRMLYIEKCANSKAVTIFIRGGNKMMIEETKRSIHDALCVARNLIINNSIVYGGGSAEISCSIAVEAAADRHPGVEQYAIRAFADALDAIPLALAENSGLPPIDTLTVVKSQHVKENNSRCGIDCNDVGTNDMKEQNVFETLIGKQQQILLATQVVKMILKIDDVITPSEY

SEQ ID NO: 3860 - protein, 535 aa, Elaeis guineensis
MALAFDEYGRPFIILKEQEQKSRLRGLEAQKANISAGKAVARILRTSLGPKGMDKMLQSPDGDVTITNDGATILEQMDVDNQIAKLMVELSRSQDYEIGDGTTGVVVMAGALLEQAEKLLERGIHPIRIAEGYEMASRIAVEHLEHISQKFEFTVGNIEPLVQTCMTTLSSKIVNRCKRMLAEIAVKAVLAVADLERKDVNLDLIKVEGKVGGKLEDTELVYGITVDKDMSHPQMPKRIEDAKIAILTCPFEPPKPKTKHKVDIDTVEKFQTLRQQERKYFDDMVQKCKDVGATLVICQWGFDDEANHLLMHRNLPAVRWVGGVELELIAIATGARIVPRFQELTPEKLGRAGLVREKSFGTTKDRMLYIEQCANSRAVTVFIRGGNKMMIEETKRSLHDALCVARNLIRNNSIVYGGGSAEISCSIAVEAAADKYPGVEQYAIRSFAEALDSIPMALAENSGLQPINTLTAVKSQQIKENNPYCGIDCNDVGTNNMQQQNVFETLIGKQQQILLATQVVKMILKIDDVIAPSDY

SEQ ID NO: 3861 - protein, 535 aa, Nicotiana tabacum
MALAFDEFGRPFIILREQEQKTRLRGLDAQKANISAGKAVARILRTSLGPKGMDKMLQSPDGDVTITNDGATILEQMDVDNQIAKLMVELSRSQDYEIGDGTTGVVVMAGALLEQAEKLLERGIHPIRVAEGYEMASRIAVEHLECVANKFEFGLNDVEPLIQTCMTTLSSKIVNRCKRSMAEIAVKAVLAVADLERKDVNLDLIKVEGKVGGKLEDTELIYGIVVDKDMSHPQMPKQIEDAKIAILTCPFEPPKPKTKHKVDIDSVEKFQTLRQQEQKYFDDMVQKCKDVGATLVICQWGFDDEANHLLMHRNLPAVRWVGGVELELIAIATGGRIVPRFQELTPEKLGKAGIVREKSFGTTKDRMIYIEHCANSRAVTIFIRGGNKMMIEETKRSIHDALCVARNLIRNNSIVYGGGSAEISCSIAVEAAADKHPGVEQYAIRAFADALDSVPMALAENSGLQPIETLSAVKAQQIKENNPCCGIDCNDVGTNDMREQNVFETLIGKQQQILLATQVVKMILKIDDVISPSEY

SEQ ID NO: 3862 - protein, 535 aa, Citrullus lanatus
MALAFDEFGRPFIILKEQEQKTRLRGLDAQKANIASGKAVARILRTSLGPKGMDKMLQSPDGDVTITNDGATILEQMDVDNQIAKLMVELSRSQDYEIGDGTTGVVVMAGALLEQAERLLERGIHPIRIAEGYELASRIAVDHLEHIAQKFDFGETNLEPLIQTCMTTLSSKIVNRCKRSLAEIAVKAVVAVADLERRDVNLDLIKVEGKVGGKLEDTELVYGIIVDKDMSHPQMPKQIEDAKIAILTCPFEPPKPKTKHKVDIDTVEKFQTLRLQEQKYFDDMVQKCKDVGATLVICQWGFDDEANHLLMHRNLPAVRWVGGVELELIAIATGGRIVPRFQELTSEKLGKAGLVREKSFGTTKDRMLYIEHCANSRAVTIFIRGGNKMMIEETKRSIHDALCVARNLIRNNSIVYGGGSAEISCSVAVETAADKYPGVEQYAIRAFADALDAVPMALAENSGLQPIETLSAVKSQQIKENNPYCGIDCNDIGTNDMREQNVFETLIGKQQQILLATQVVKMILKIDDVISPSEY

SEQ ID NO: 3863 - protein, 535 aa, Nicotiana benthamiana
MALAFDEFGRPFIILREQEQKTRLRGLDAQKANISAGKAVARILRTSLGPKGMDKMLQSPDGDVTITNDGATILEQMDVDNQIAKLMVELSRSQDYEIGDGTTGVVVMAGALLEQAEKLLERGIHPIRVAEGYEMASRIAVEHLERVANKFEFGLNDVEPLIQTCMTTLSSKIVNRCKRSMAEIAVKAVLAVADLERKDVNLDLIKVEGKVGGKLEDTELIYGIVVDKDTSHPQMPKQIEDAKIAILTCPFEPPKPKTKHKVDIDSVEKFQTLRQQEQKYFDDMVQKCKDVGATLVICQWGFDDEANHLLMHRNLPAVRWVGGVELELIAIATGGRIVPRFQELTPEKLGKAGVVREKSFGTTKDRMIYIEHCANSKAVTIFIRGGNKMMIEETKRSIHDALCVARNLIRNNSIVYGGGSAEISCSIAVEAAADKHPGVEQYAIRAFADALDSVPMALAENSGLQPIETLSAVKAQQIKENNPCCGIDCNDVGTNDMREQNVFETLIGKQQQILLATQVVKMILKIDDVISPSEY

SEQ ID NO: 3864 - protein, 535 aa, Cucumis sativus
MALAFDEYGRPFIILKEQEQKTRLRGLDAQKANIASGKAVARILRTSLGPKGMDKMLQSPDGDVTITNDGATILEQMDVDNQIAKLMVELSRSQDYEIGDGTTGVVVMAGALLEQAERLLERGIHPIRVAEGYELASRIAVDHLEHIAQKFDFGEKNLEPLIQTCMTTLSSKIVNRCKRSLAEIAVKAVVAVADLERRDVNLDLIKVEGKVGGKLEDTELVYGIIVDKDMSHPQMPKQIEDAKIAILTCPFEPPKPKTKHKVDIDTVEKFQTLRLQEQKYFDDMVQKCKDVGATLVICQWGFDDEANHLLMHRNLPAVRWVGGVELELIAIATGGRIVPRFQELTSEKLGKAGLVREKSFGTTKDRMLYIEHCANSRAVTIFIRGGNKMMIEETKRSIHDALCVARNLIRNNSIVYGGGSAEISCSVAVETAADKYPGVEQYAIRAFADALDAVPMALAENSGLQPIETLSAVKSQQIKENNPYCGIDCNDIGTNDMREQNVFETLIGKQQQILLATQVVKMILKIDDVISPSDY

SEQ ID NO: 3865 - protein, 535 aa, Secale cereale
MALAFDEYGRPFIILREQEKKSRLQGLDAQKANIAAGKSVARILRTSLGPKGMDKMLQSPDGDVTITNDGATILELMDVDNQIAKLMVELSRSQDYDIGDGTTGVVVMAGSLLEQAEKLLERGIHPIRIAEGYEMASRIAVDHLESISTKYEFSATDIEPLVQTCMTTLSSKIVSRCKRALAEIAVKAVLAVADLERKDVNLDLIKVEGKVGGKLEDTELVQGIIVDKDMSHPQMPKRIEDAHIAILTCPFEPPKPKTKHKVDIDTVEKFQTLRGQEQKYFDDMVQKCKDVGATLVICQWGFDDEANHLLMQRELPAVRWVGGVELELIAIATGGRIVPRFQELTTEKLGKAGLVREKSFGTTKDRMLYIEKCANSKAVTIFIRGGNKMMIEETKRSIHDALCVARNLIINNSIVYGGGSAEISCSIAVDAAADRHPGVEQYAIRAFADALDAIPLALAENSGLPPIDTLTVVKSQHVKENNSRCGIDCNDVGTNDMKEQNVFETLIGKQQQILLATQVVKMILKIDDVITPSEY

SEQ ID NO: 3866 - protein, 535 aa, Solanum phureja
MALAFDEFGRPFIILREQEQKTRLRGLDAQKANISAGKAVARILRTSLGPKGMDKMLQSPDGDVTITNDGATILEQMDVDNQIGKLMVELSRSQDYEIGDGTTGVVVMAGALLEQAEKLLERGIHPIWIAEGYEMASRIAVEHLERVAHKFEFGLNDIEPLVQTCMTTLSSKIVNRCKRSMAEIAVKAVLAVADLERKDVNLDLIKVEGKVGGKLEDTELIYGIIVDKDMSHPQMPKQIEDAKIAILTCPFEPPKPKTKHKVDIDTVEKFQTLRLQEQKYFDDMVQKCKDVGATLVICQWGFDDEANHLLMHRNLPAVRWVGGVELELIAIATGGRIVPRFQELTSEKLGKAGIVREKAFGTTKDRMIYIEHCANSRAVTVFIRGGNKMMIEETKRSIHDALCVARNLIRNNSIVYGGGSAEISCSIAVEAAADKHPGVEQYAIRAFADALDSVPMALAENSGLQPIETLSAVKSQQIKENNPCCGIDCNDVGTNDMREQNVFETLIGKQQQILLATQVVKMILKIDDVITPSAY

SEQ ID NO: 3867 - protein, 535 aa, Triticum aestivum
MALAFDEYGRPFIILREQEKKSRLQGLDAQKANIAAGKSVARILRTSLGPKGMDKMLQSPDGDVTITNDGATILELMDVDNQIAKLMVELSRSQDYDIGDGTTGVVVLAGSLLEQAEKLLERGIHPIRIAEGYEMASRIAVDHLESISTKYEFSATDIEPLVQTCMTTLSSKIVSRCKRALAEIAVKAVLAVADLERKDVNLDLIKVEGKVGGKLEDTELVQGIIVDKDMSHPQMPKRIEDAHIAILTCPFEPPKPKTKHKVDIDTVEKFQTLRGQEQKYFDDMVQKCKDVGATLVICQWGFDDEANHLLMQRELPAVRWVGGVELELIAIATGGRIVPRFQELTTEKLGKAGLVREKSFGTTKDRMLYIEKCANSKAVTIFIRGGNKMMIEETKRSIHDALCVARNLIINNSIVYGGGSAEISCSIAVDAAADRHPGVEQYAIRAFADALDAIPLALAENSGLPPIDTLTVVKSQHVKENNSRCGIDCNDVGTNDMKEQNVFETLIGKQQQILLATQVVKMILKIDDVITPSEY

SEQ ID NO: 3868 - protein, 535 aa, Prunus mume
MALAFDEYGRPFIILREQEQKTRLRGLDAQKANISAGKAVARILRTSLGPKGMDKMLQSPDGEVTVTNDGATILEQMDVDNQIAKLMVELSQSQDYEIGDGTTGVVVLAGALLEHAERLLERGIHPIRVAEGYEMASRIAFDHLQHISQKFEFGLDNIEPLVRTCMTTLSSKIVNRCKRDLAEIAVKAVLAVADLERKDVNLDLIKVEGKVGGKLEDTELVYGILIDKDMSHPQMPKRIENAKIAILTCPFEPPKPKTKHKVDIDTVEKFQTLRLQEQKYFDDMVQQCKDVGATLVICQWGFDDEANHLLMHRNLPAVRWVGGVELELIAIATGGRIVPRFQELTPDKLGKAGIVREKSFGTTKDRMLYIEHCANSRAVTIFIRGGNKMMIEETKRSIHDALCVARNLIRNNSIVYGGGSAEISCSVAVEAAADKYPGVEQYAIRAFADALDSVPMALAENSGLQPIETLSAVKSQQIKENNPHCGIDCNDVGTNDMREQNVFETLIGKQQQILLATQVVKMILKIDDVISPSDI

SEQ ID NO: 3869 - protein, 223 aa, Aristolochia fimbriata
MALAFDEFGRPYIIIKEQEHKSRLRGLDAHKANISAAKAVARILRTSLGPKGMDKMLQSPDGDVTITNDGATILEQMDVDNHIAKLMVELSRSQDYEIGDGTTGVVVMAGALLEQAEKLLERGIHPIRVAEGYEMASRLAVENLERISQKFEFSSTNIEPLVQTCMTTLSSKIVNRCKRSLAEIAVKAVLSVADLERKDVNLDLIKVEGKLVASWRIQSLLTE

SEQ ID NO: 3870 - protein, 535 aa, Eucalyptus grandis
MALAFDEFGRPFIILKEQEQKTRLRGLDAQKTNIAAGKAVARILRTSLGPKGMDKMLQSPDGEVTITNDGATILEQMDVDNQIAKLMVELSRSQDYEIGDGTTGVVVMAGALLEQAEKLLDRGIHPIRIAEGYELASRIAFEHLERIAQKFEFGLSNTESLVQTCMTTLSSKIVNRCKRDLAEIAVQAVLAVADLERRDVNLDLIKVEGKVGGKLEDTELIYGITLDKDMSHPQMPKRIEDAKIAILTCPFEPPKPKTKHKVDIDTVEKFQTLRVQEQKYFDDMVQKCKDVGATLVICQWGFDDEANHLLMHRNLPAVRWVGGVELELIAIATGGRIVPRFQELTPEKLGKAGLVREKSFGTTKDRMLYIEHCANSRAVTVFIRGGNKMMIEETKRSIHDALCVARNLIRNNSIVYGGGSAEISCSIAVEAAADRYPGVEQYAIRGFADALDAIPMALAENSGLQPIETLSAVKSQQIKENNPFCGIDCNDVGTNDMCEQNVFEALIGKQQQILLATQVVKMILKIDDVISPSDF

SEQ ID NO: 3871 - protein, 535 aa, Elaeis guineensis
MALAFDEYGRPFIILKEQERKSRLRGLEAQKANISAGKAVARILRTSLGPKGMDKMLQSPDGDVTITNDGATILEQMDVNNQIAKLMVELSRSQDCEIGDGTTGVVVVAGALLEQAEKLLERGIHPIRIAEGYEMASRIAVEHLERISQKFEFSVSNIEPLVQTCMTTLSSKIVNRCKRMLAEIAVKAVLAVADLERKDVNLDLIKIEGKVGGKLEDTELIYGITVDKEMSHPQMPKRIEDAKIAILTCPFEPPKPKTKHKVDIDTVEKFQTLRQQEQKYFDDMVQKCKDVGATLIICQWGFDDEANHLLMHRNLPAVRWVGGVELELIAIATGGRIVPRFQELTPEKLGRAGLVREKSFGTTKDRMLYIEQCANSRAVTIFIRGGNKMVIEETKRSLHDALCVARNLIRNNSIVYGGGSAEISCSIAVEAAADRYPGVEQYAIRSFAEALDSIPMALAENSGLQLIDTLTAVKSQQIKENNPYCGIDCNDVGTNNMQEQNVFETLIGKQQQILLATQVVKMILKIDDVITPSDY

SEQ ID NO: 3872 - protein, 535 aa, Arachis hypogaea
MALAFDEFGRPFIILKEQEQKSRLRGLDAQKANISAGKAVARILRTSLGPKGMDKMLQSPDGDVIITNDGATILEQMDVDNQIAKLMVELSRSQDYEIGDGTTGVVVMAGALLEQAERLLERGIHPIRVAEGYEMASRIAVDHLENIAKKFEFGPTDLEPLIQTCMTTLSSKIVNRCKRSLAEIAVKAVLAVADLERKDVNLDLIKVEGKVGGKLEDTELIYGIVVDKDMSHPQMPKRIEDAKIAILTCPFEPPKPKTKHKVDIDTVEKFQTLRKQEQQYFDDMVQKCKDVGATLVICQWGFDDEANHLLMHRNLPAVRWVGGVELELIAIATGGRIVPRFQELSPEKLGKAGVVREKSFGTTKDRMLYIEHCANSRAVTIFTRGGNKMIIEETKRSLHDALCVARNLIRNNSIVYGGGSAEISCSIAVEAAADRYPGVEQYAIRAFGDALEAIPMALAENSGLQPIETLSAVKSQQIKDNNPNFGIDCNDVGTNDMREQNVFETLIGKQQQILLATQVVKMILKIDDVISPSEF

SEQ ID NO: 3873 - protein, 535 aa, Phalaenopsis aphrodite
MALAFDEYGRPFIIIKEQEQKRRLRGLDAQKANINAGKAVARILRTSLGPKGMDKMLQSPDGDVTITNDGATILEQMDVDNQIAKLMVELSRSQDYEIGDGTTGVVVMAGALLEQAEKLLERGIHPVRVAEGYEMASRIAVEHLERIAHKFDFSVTNIEPLVQTCMTTLSSKIVNRCKKSLAEIAVKAVLAVADLERKDVNLDLIKVEGKVGGKLEDTELIYGIIVDKDMSHPQMPKRIEDAKIAILTCPFEPPKPKTKHKVDIDTVEKFQTLRQQELKYFDDMVQKCKDVGATLVICQWGFDDEANHLLMHRNLPAVRWVGGVELELIAIATGGRIVPRFQELTPEKLGRAGLVREKSFGTTKDRMLYIEQCANSRAVTIFIRGGNKMMIEETKRSLHDALCVARNLIRNNSIVYGGGSAEISCSIAVDAAAYRYPGVEQYAIRSFAEALDLIPMALAENSGLQPIETVSAVKSQQIKENTPFCGIDCNDVGTNNMQEQNVFETLIGKQQQILLATQVVKMILKIDDVISPSEY

SEQ ID NO: 3874 - protein, 535 aa, Mimulus guttatus
MALAFDEYGRPFIILREQDQKTRLRGLDAQKENIAAGKAVARILRTSLGPKGMDKMLQSPDGDVTITNDGATILELMDVDNQIGKLMVELSRSQDYEIGDGTTGVVVMAGSLLEQAEKLLERGIHPIRIAEGYEMASRIAFEHLERISHKFEFTEADMEPLIQPCMTTLSSKIVNRCKRAMAEIAVKAVLAVADLERKDVNLDLIKVEGKVGGKLEDTELIYGIVVDKDMSHPQMPKQIEDAKIAILTCPFEPPKPKTKHKVDIDTVEKFQTLREQERKYFDDMVQKCKDVGATLVICQWGFDDEANHLLMHRELPAVRWVGGVELELIAIATGGRIVPRFQELTTDKLGKAGIVREKAFGTTKDRMIYIEHCANSRAVTIFIRGGNKMMIEETKRSIHDALCVARNLIRNNSIVYGGGSAEISCSIAVEAAADKHPGVEQYAIRAFADALDAIPMALAENSGLQPIETLSAVKAQQIKENNSCCGIDCNDVGTNDMREQNVFETLIGKQQQILLATQVVKMILKIDDVISPSDY

SEQ ID NO: 3875 - protein, 535 aa, Amorphophallus konjac
MALAFDEYGRPFIILREQEQKTRLRGLEAQKANIAAGKAVARILRTSLGPKGMDKMLQSPDGDVTITNDGATILEQMDVDNQIAKLMVELSRSQDYEIGDGTTGVVVLAGALLEQSEKLLERGIHPIRVAEGYEMASRIAVEHLEKISQKFEFSVTNIEPLVQTCSTTLSSKIVSRQKHDLAGIAVEAVLAVADLERKDVNLDLIKVEGKVGGKLEDTELIRGIVVDKDMSHPQMPKRIEDAKIAILTCPFEPPKPKTKHKVDIDTVEKFQTLRQQEQKYFDDMVQKCKDVGATLVICQWGFDDEANHLLMHRNLPAVRWVGGVELELIAIATGGRIVPRFQELTPEKLGRAGLVREKSFGTTKDRMLYIEQCANSRAVTIFIRGGNKMMIEETKRSIHDALCVARNLIRNNSIVYGGGSAEISCSIAVEAAADRYPGVEQYAIRSFAEALDSIPMALAENSGLQPIDTLTAVKSQQIKEKNPYCGIDCNDVGTNDMREQDVFETLIGKQQQVLLATQVVKMILKIDDVITPSDF

SEQ ID NO: 3876 - protein, 535 aa, Catharanthus roseus
MALAFDEFGRPFIIIREQEQKTRLRGLDAQKANISAGKAVARILRTSLGPKGMDKMLQSPDGDVTITNDGATILEQMDVDNQIAKLMVELSRSQDYEIGDGTTGVVVMAGALLEQAERLLERGIHPIRIAEGYEVASRIAFEHLERIAHKYEFDAANPEPLIQTCMTTLSSKIVNRCKRSLAEIAVKAVLAVADLERKDVNLDLIKVEGKVGGKLEDTELIYGIVVDKDMSHPQMPKEIKDANIAILTCPFEPPKPKTKHKVDIDTVEKFQTLRDQEQKYFDDMVQKCKDVGATLVICQWGFDDEANHLLMHRNLPAVRWVGGVELELIAIATGGRIVPRFQELTPEKLGRAGLVREKSFGTTKDRMIYIEHCANSRAVTIFIRGGNKMMIEETKRSIHDALCVARNLIRNNSIVYGGGSAEISCSVAVEAAADKYPGVEQYAIRAFADALDSIPMALAENSGLQPIETLSAVKSQQIKENNPCCGIDCNDVGTNDMREQNVFETLIGKQQQILLATQVVKMILKIDDVISPSEY

SEQ ID NO: 3877 - protein, 535 aa, Flaveria ramosissima
MALAFDEYGRPFIILREQESKSRLRGLDAQKANIAAGVAVSRILRTSLGPKGMDKMLQSPDGDITITNDGATILEQMDVDNQIGKLMVELSRSQDYEIGDGTTGVVVMAGALLEQAEKLLERGIHPIRVAEGFEISSRIAVDHLEKIAHKFDFSATNIEPLVQTCMTTLSSKIVNRCKRSLAEIAVKSVMAVADLERKDVNLDLIKVEGKVGGKLEDTELIYGIIVDKDMSHPQMPKQIEDAKIAILTCPFEPPKPKTKHKVDIDTVEKFQTLRKQEQKYFDDMVQKCKDVGATLVICQWGFDDEANHLLMHRNLPAVRWVGGVELELIAIATGGRIVPRFQELTPEKLGKAGLVREKAFGTTKDRMLYIEHCANSKAVTIFIRGGNKMMIEETKRSIHDALCVARNLIRNNSIVYGGGAAEISCSIAVEAAADKYPGVEQYAIRAFADALDSVPMALAENSGLQPIETLSAVKAQQIKENNPCCGIDCNDTGTNDMREQNVFETLIGKQQQILLATQVVKMILKIDDVISPSDY

SEQ ID NO: 3878 - protein, 535 aa, Quercus alba
MALAFDEFGRPFIIIKEQEQKTRLRGLEAQKANISAGKAIARILKTSLGPKGMDKMLQSPDGDVTITNDGATILEQMDVDNQIAKLMVELSRSQDYEIGDGTTGVVVMAGALLEQAELLLERGIHPIRIAEGYEMASRIAFEHMEKIAQKFDYGVSNFEPLVQTCMTTLSSKIVNRCKRNLAEIAVKAVLAVADLERKDVNLDLIKVEGKVGGKLEDTELIYGILVDKDMSHPQMPKQIEDAKIAILTCPFEPPKPKTKHKVDIDTVEKFQNLRQQEHKYFDDMVQQCKDVGATLVICQWGFDDEANHLLMHRNLPAVRWVGGVELELIAIATGGRIVPRFQELTPEKLGKAGLVREKAFGTTKDRMLYIEHCANSRAVTIFIRGGNKMMIEETKRSIHDALCVARNLIRNNRIVYGGGSAEISCSIAVEAAADRHPGVEQYAIRAFADALDAVPMALAENSGLQPIETLSAVKSQQIKENNPYCGIDCNDVGTNDMREQNVFETLIGKQQQLLLATQVVKMILKIDDVISPSEY

SEQ ID NO: 3879 - protein, 535 aa, Plantago ovata
MALAFDEFGRPFIIIREQEQKSRLRGLDAQKANISAGKAVARILRTSLGPKGMDKILQSPDGDVTITNDGATILDLMDVDNQIAKLMVELSRSQDYEIGDGTTGVVVMAGALLEQAEKLLERGIHPIRVAEGYEMASRIAFEHLERIAHKFEFGGTNTEPLIQTCMTTLSSKIVNRCKRSMAEIAVKAVLAVADLERRDVNLDLIKVEGKVGGKLEDTELIYGIVVDKDMSHPQMPKQIEDAKIAILTCPFEPPKPKTKHKVDIDSVEKFQTLRHQEQKYFDDMVQQCKDVGATLVICQWGFDDEANHLLMHRNLPAVRWVGGVELELIAIATGGRIVPRFQELTSEKLGKAGLVREKAFGTTKDRMIYIEHCANSRAVTIFIRGGNKMMIEETKRSLHDALCVARNLIRNNSIVYGGGSAEISCSLAVEAAADKHPGVEQYAIRAFADALDSIPMALAENSGLQPIETLSAVKSQQIKENNPCCGIDCNDVGTNDMREQNVFETLIGKQQQILLATQVVKMILKIDDVISPSEY

SEQ ID NO: 3880 - protein, 535 aa, Triticum aestivum
MALAFDEYGRPFIILREQEKKSRLQGLDAQKANIAAGKSVARILRTSLGPKGMDKMLQSPDGDVTITNDGATILELMDVDNQIAKLMVELSRSQDYDIGDGTTGVVVLAGSLLEQAEKLLERGIHPIRIAEGYEMASRIAVDHLESISTKYEFSATDIEPLVQTCMTTLSSKIVSRWKRSLAEIAVKAVLAVADLERKDVNLDLIKVEGKVGGKLEDTELVQGIIVDKDMSHPQMPKRIEDAHIAILTCPFEPPKPKTKHKVDIDTVEKFQTLRGQEQKYFDDMVQKCKDVGATLVICQWGFDDEANHLLMQRELPAVRWVGGVELELIAIATGGRIVPRFQELTTEKLGKAGLVREKSFGTTKDRMLYIEKCANSKAVTIFIRGGNKMMIEETKRSIHDALCVARNLIINNSIVYGGGSAEISCSIAVDAAADRHPGVEQYAIRAFADALDAIPLALAENSGLPPIDTLTVVKSQHVKENNSRCGIDCNDVGTNDMKEQNVFETLIGKQQQILLATQVVKMILKIDDVITPSEY

SEQ ID NO: 3881 - protein, 535 aa, Musa acuminata
MALAFDEYGRPFIIIKEQGQKARLRGLDAQKANISAGKAVARILRTSLGPKGMDKMLQSPDGDVVITNDGATILEQMDVDNQIAKLMVELSRSQDYEIGDGTTGVVVLAGALLEQAEKLLERGIHPIRISEGYEMASKLSVEHLESISQKFEFSVTNIEPLVQTCMTTLSSKIVNRCKRALAEIAVKAVLAVADLERKDVNLELIKVEGKVGGKLEDTELIYGILVDKDMSHPQMPKRIEDANIAILTCPFEPPKPKTKHKIDIDTVEKFQTLRQQEQNYFDDMVQKCKDVGATLVICQWGFDDEANHLLMHRNLPAVRWVGGVELELIAIATGGRIVPRFQELTTEKLGKAGLVREKSFGTTKDRMLYIEHCANSRAVTIFIRGGNKMMIEETKRSLHDALCVARNLIRNNSIVYGGGSAEISCSIAVEAAADRYPGVEQYAIRSFAEALDSIPMALAENSGLPPIDTLTAVKSQQIKEGNPYCGIDCNDVGTNNMREQNVFETLIGKQQQILLATQVVKMILKIDDVITPAEY

SEQ ID NO: 3882 - protein, 535 aa, Theobroma cacao
MALAFDEFGRPFIIIKEQEQKTRLRGIEAQKANISAGKAVARILRTSLGPKGMDKMLQSPDGDVTITNDGATILEQMDVDNQIAKLMVELSRSQDYEIGDGTTGVVVMAGALLEQAERLLERGIHPIRVAEGYELASRIAVEHLEHIAQKFDFGPTNIEPLVQTCMTTLSSKIVNRCKRPLAEISVKAVLSVADLERKDVNLDLIKVEGKVGGKLEDTELIYGITVDKDMSHPQMPKQIEDAKIAILTCPFEPPKPKTKHKVDIDTVEKFQTLRLQEQKYFDDMVQKCKDVGATLVICQWGFDDEANHLLMHRNLPAVRWVGGVELELIAIATGGRIVPRFQELTPEKLGRAGLVREKSFGTTKDKMLYIEHCANSRAVTIFIRGGNKMMIEETKRSIHDALCVARNLIRNNSIVYGGGSAEISCSIAVEAAADKYPGVEQYAIRAFADALDAVPMALAENSGLQPIETLSAVKSEQIKENNPHFGIDCNDVGTNDMREQNVFETLIGKQQQILLATQVVKMILKIDDVISPSDY

SEQ ID NO: 3883 - protein, 535 aa, Manihot esculenta
MALAFDEFGRPFIILKEQEQKTRLRGLDAQKANISAGRAVARILRTSLGPKGMDKMLQSPDGDVTITNDGATILEQMDVDNQIAKLMVELSRSQDYEIGDGTTGVVVMAGALLEQAEKLLERGIHPIRVAEGYEMASRIAVENLERIANKFDFGVTNLEPLIQTCMTTLSSKIVNRCKHSLAEIAVKAVLAVADLERKDVNLDLIKVEGKVGGKLEDTELIYGIVVDKDMSHPQMPKQIEDAKIAILTCPFEPPKPKTKHKVDIDTVEKFQTLRKQEQQYFDDMVQKCKDVGATLVICQWGFDDEANHLLMHRNLPAVRWVGGVELELIAIATGGRIVPRFQELTTEKLGKAGLVREKSFGTTKDRMLYIEHCANSRAVTIFIRGGNKMMIEETKRSLHDALCVARNLIRNNSIVYGGGSAEISCSVAVEAAADRYPGVEQYAIRAFADALDSIPMALAENSGLQPIETLSAVKSQQIKENNPHYGIDCNDVGTNDMCEQNVFEALIGKQQQILLATQVVKMILKIDDVISPSDF

SEQ ID NO: 3884 - protein, 535 aa, Castanea mollissima
MALAFDEFGRPFIIIKEQEQKTRLRGLEAQKANISAGKAIARILKTSLGPKGMDKMLQSPDGDVTITNDGATILEQMDVDNQIAKLMVELSRSQDYEIGDGTTGVVVMAGALLEQAELLLERGIHPIRIAEGYEMASRIAFEHMEKIAQKFDYGVSNFEPLVQTCMTTLSSKIVNRCKRNLAEIAVKAVLAVADLERKDVNLDLIKVEGKVGGKLEDTELIYGILVDKDMSHPQMPKQIEDAKIAILTCPFEPPKPKTKHKVDIDTVEKFQNLRQQEHKYFDDMVQQCKDVGATLVICQWGFDDEANHLLMHRNLPAVRWVGGVELELIAIATGGRIVPRFQELTPEKLGKAGLVREKAFGTTKDRMLYIEHCANSRAVTIFIRGGNKMMIEETKRSIHDALCVARNLIRNNRIVYGGGSAEISCSIAVEAAADRYPGVEQYAIRAFADALDAVPMALAENSGLQPIETLSAVKSQQIKENNPYCGIDCNDVGTNDMREQNVFETLIGKQQQLLLATQVVKMILKIDDVISPSEY

SEQ ID NO: 3885 - protein, 535 aa, Cirsium arvense
MALAFDEYGRPFIILREQESKSRLRGLDAQKSNIAAGVAVSRILRTSLGPKGMDKMLQSPDGDITITNDGATILEQMDVDNQIGKLMVELSRSQDYEIGDGTTGVVVMAGALLEQAEKLLERGIHPIRVAEGFEISSRIAVDHLEQISHKFDFSATNIEPLVQTCMTTLSSKIVNRCKRSLAEIAVKGVMAVADLERKDVNLDLIKVEGKVGGKLEDTELIYGIIVDKDMSHPQMPKQIEDAKIAILTCPFEPPKPKTKHKVDIDTVEKFQTLREQERKYFDDMVMRCKDVGATLVICQWGFDDEANHLLMHRNLPAVRWVGGVELELIAIATGGRIVPRFQELTPEKLGKAGLVREKAFGTTKDRMLYIEHCANSRAVTIFIRGGNKMMIEETKRSIHDALCVARNLIRNNSIVYGGGAAEISCSIAVEAAADKYPGVEQYAIRAFADALDSVPMALAENSGLQPIETLSAVKAQQIKEKNPCCGIDCNDAGTNDMRDQNVFETLIGKQQQILLATQVVKMILKIDDVISPSEY

SEQ ID NO: 3886 - protein, 535 aa, Lactuca sativa
MALAFDEYGRPFIILREQESKTRLRGLDAQKANIAAGVAVSRILRTSLGPKGMDKMLQSPDGDITITNDGATILEQMDVDNQIGKLMVELSRSQDYEIGDGTTGVVVLAGALLEQAEKLLERGIHPIRVAEGFEISSRIAVDHLEQIAHKFDFNATNIEPLVQTCMTTLSSKIVNRCKRSLAEIAVKAVMAVADLERKDVNLDLIKVEGKVGGKLEDTELIYGIIVDKDMSHPQMPKQIEDAKIAILTCPFEPPKPKTKHKVDIDTVEKFQTLRKQEQKYFDDMVQRCKDVGATLVICQWGFDDEANHLLMHRNLPAVRWVGGVELELIAIATGGRIVPRFQELTTEKLGKAGLVREKAFGTTKDRMLYIEHCANSRAVTVFIRGGNKMMIEETKRSIHDALCVARNLIRNNSIVYGGGAAEISCSIAVEAAADKYPGVEQYAIRAFADALDSVPMALAENSGLSCIETLSAVKAQQIKENNPCCGIDCNDTGTNDMREQNVFETLIGKQQQMLLATQVVKMILKIDDVISPSEY

SEQ ID NO: 3887 - protein, 535 aa, Prunus persica
MALAFDEYGRPFIILREQEQKTRLRGLDAQKANISAGTAVARILRTSLGPKGMDKMLQSPDGEVTVTNDGATILEQMDVDNQIAKLMVELSQSQDYEIGDGTTGVVVLAGALLEHAERLLERGIHPIRVAEGYEMASRIAFDHLQHIAQKFEFGLDNIEPLVRTCMTTLSSKIVNRCKRDLAEIAVKAVLAVADLERKDVNLDLIKVEGKVGGKLEDTELVYGILIDKDMSHPQMPKRIENAKIAILTCPFEPPKPKTKHKVDIDTVEKFQTLRLQEQKYFDDMVQQCKDVGATLVICQWGFDDEANHLLMHRNLPAVRWVGGVELELIAIATGGRIVPRFQELTPDKLGKAGIVREKSFGTTKDRMLYIEHCANSRAVTIFIRGGNKMMIEETKRSIHDALCVARNLIRNNSIVYGGGSAEISCSVAVEAAADKYPGVEQYAIRAFADALDSVPMALAENSGLQPIETLSAVKSQQIKENNPHCGIDCNDVGTNDMREQNVFETLIGKQQQILLATQVVKMILKIDDVISPSDF

SEQ ID NO: 3888 - protein, 503 aa, Panicum virgatum
MALAFDEFGRPFIILREQEKKTRLRGLDAQKANIAAGKAVARILRTSLGPKGMDKMLQSPDGDVTITNDGATILEQMDVDNQIAKLMVELSRSQDYEIGDGTTGVVVMAGALLEQAEKLLERGIHPIRVAEGYEMASRIAFEHLERISHKFEFSADNIEPLVQTCMTTLSSKIVNRCKRALAEIAVKAVLAVADLERKDVNLDLIKVEGKVGGKLEDTELIYGIVVDKDMSHPQMPKRIEDAKIAILTCPFEPPKPKTKHKVDIDTVEKFQTLREQEQKYFDEMVQKCKDVGATLVICQWGFDDEANHLLMHRNLPAVRWVGGVELELIAIATGGRIVPRFQELSPEKLGKAGLVREKSFGTTKDRMLYIEQCVNSRAVTIFIRGGNKMMIEETKRSLHDALCVARNLIRNNSIVYGGGSAEISCSIAVETAADRHPGVEQYAIRSFADALDAVPLALAENSGLPPIDTLTAVKAQQVKESNPHCGIDCNDVGTNDMKGTERV

SEQ ID NO: 3889 - protein, 535 aa, Ricinus communis
MALAFDEYGRPFIILKEQEAKSRLRGLDAQKANISAGKAVARILRTSLGPKGMDKMLQSPDGDVTITNDGATILEQMDVDNQIAKLMVELSRSQDYEIGDGTTGVVVMAGSLLEQAEKLLERGIHPIRVAEGYEMASKIAVEHLEHISEKFDFGLNDIEPLVQTCMTTLSSKIVNRCKRSLAEISVKAVLAVADLERKDVNLDLIKVEGKVGGKLEDTELIYGIVVDKDMSHPQMPKHIEDAKIAILTCPFEPPKPKTKHKVDIDSVEKFQTLRKQEQQYFDDMVQKCKDAGATLVICQWGFDDEANHLLMHRNLPAVRWVGGVELELIAIATGGRIVPRFQELTPEKLGKAGMVREKSFGTTKDRMLYIEHCANSRAVTIFIRGGNKMMIEETKRSIHDSLCVARNLIRNNSIVYGGGSAEISCSIAVEAAADKYPGVEQYAIRAFADSLDAIPMALAENSGLQPIETLSAVKSQQIKENNPHCGIDCNDAGTNDMREQYVFETLIGKQQQILLATQVVKMILKIDDVISPSEY

SEQ ID NO: 3890 - protein, 535 aa, Artemisia annua
MALAFDEYGRPFIILREQESKSRLRGIDAQKANIAAGVAVSRILRTSLGPKGMDKMLQSPDGDITITNDGATILEQMDVDNQIGKLMVELSRSQDYEIGDGTTGVVVMAGALLEQAEKLLERGIHPIRVAEGFEISSRIAVDHLESIADKFNFTATNIEPLVQTCSTTLNSKIVNRCKRSLAEIAVKAVMAVADLERRDVNLDLIKVEGKVGGKLEDTELIYGILVDKDMSHPQMPKQIQDAHIAILTCPFEPPKPKTKHKVDIDTVEKFQTLRKQEQQYFDEMVQKCKDVGATLVICQWGFDDEANHLLMHRNLPAVRWVGGVELELIAIATGGRIVPRFQELTPEKLGKAGLVREKAFGTTKDRMLYIEHCANSRAVTIFIRGGNKMMIEETKRSIHDALCVARNLIRNNSIVYGGGAAEISCSIAVEAAADKYPGVEQYAIRAFADALDAVPMALAENSGLSPIETLSAVKAQQIKENNHCCGIDCNDTGTNDMREQNVFETLIGKQQQILLATQVVKMILKIDDVISPSEY

SEQ ID NO: 3891 - protein, 535 aa, Manihot esculenta
MALAFDEFGRPFIILKEQEQKTRLRGLDAQKANISAGRTVARILRTSLGPKGMDKMLQSPDGDVTITNDGATILEQMDVDNQIAKLMVELSRSQDYEIGDGTTGVVVVAGALLEQAEKLLERGIHPIRIAEGYEMASRIAVEHLEHIAQKFDFGVTNLEPLIQTCMTTLSSKIVNRCKRSLAEISVKAVIAVADLERKDVNLDLIKVEGKVGGKLEDTELIYGIVVDKDMSHPQMPKQIEDAKIAILTCPFEPPKPKTKHKVDIDTVEKFQTLRKQEQQYFDDMVQKCKDVGATLVICQWGFDDEANHLLMHRNLPAVRWVGGVELELIAIATGGRIVPRFQELTPEKLGKAGLVREKSFGTTKDRMLYIEHCANSRAVTIFIRGGNKMIIEETKRSIHDALCVARNLIRNNSIVYGGGSAEISCSIAVEAAADRYPGVEQYAIRAFADALDSIPMALAENSGLQPIETLSAVKSQQIKENNPHCGIDCNDIGTNDMSEQNVFETLIGKQQQILLATQVVKMILKIDDVISPSDY

SEQ ID NO: 3892 - protein, 535 aa, Euphorbia peplus
MALAFDEYGRPFIIIKEQEQKTRLRGLEAQKSNISAGRAVARILRTSLGPKGMDKMLQSPDGDVTITNDGATILEQMDVDNQIAKLMVELSRSQDYEIGDGTTGVVVLAGSLLEQAEKLLERGIHPIRIAEGYEMASRIAFDHLEHISHKFDFEAANIEPLVQVCMTTLSSKIVNRCKRSLAEIAVKAVLAVADLERKDVNLDLIKVEGKVGGKLEDTELVYGIIVDKDMSHPQMPKQIEDAKIAILTCPFEPPKPKTKHKVDIDTVEKFQTLRKQEQQYFDDMVQQCKDVGATLVICQWGFDDEANHLLMHRNLPAVRWVGGVELELIAIATGGRIVPRFQELTTEKLGKAGLVREKAFGTTKDRMLYIEHCANSRAVTVFIRGGNKMMIEETKRSIHDALCVARNLIRNNSIVYGGGSAEISCSIAVQAAAERHPGVEQYAIMAFADALEAVPMALAENSGLQPIETLSLVRSQQFKENNPHYGIDCNDVGTNDMREQNVFETLIGKQQQILLATQVVKMILKIDDVISPSEF

SEQ ID NO: 3893 - protein, 535 aa, Flaveria ramosissima
MALAFDEYGRPFIILREQESKSRLRGLDAQKANIAAGVAVSRILRTSLGPKGMDKMLQSPDGDITITNDGATILEQMDVDNQIGKLMVELSRSQDYEIGDGTTGVVVMAGALLEQAEKLLERGIHPIRVAEGFEISSRIAVDHLEKIAHKFDFSAKNIEPLVQTCMTTLSSKIVNRCKHSLAEIAVKSVMAVADLERKDVNLDLIKVEGKVGGKLEDTELIYGIVVDKDMSHPQMPKQIEDAKIAILTCPFEPPKPKTKHKVDIDTVEKFQTLRKQEQKYFDDMVQKCKDVGATLVICQWGFDDEANHLLMHRNLPAVRWVGGVELELIAIATGGRIVPRFQELTPEKLGKAGLVREKAFGTTKDRMLYIEHCANSKAVTIFIRGGNKMMIEETKRSIHDALCVARNLIRNNSIVYGGGAAEISCSIAVEAAADKYPGVEQYAIRAFADALDSVPMALAENSGLQPIETLSAVKAQQIKENNPCCGIDCNDTGTNDMREQNVFETLIGKQQQILLATQVVKMILKIDDVISPSDY

SEQ ID NO: 3894 - protein, 535 aa, Gossypium raimondii
MALAFDEYGRPFIILKEQEQKTRLRGIEAQKANISAGKAVARILRTSLGPKGMDKMLQSPDGDVTITNDGATILEQMDVDNQIAKLMVELSRSQDYEIGDGTTGVVVMAGALLEQAERLLERGIHPIRIAEGYEMASRIAVEHLEHIAQKFDFGPTNIELLVQTCMTTLSSKIVNRCKRPLAEIAVKAVLSVADLERKDVNLDLIKVEGKVGGKLEDTELVYGITVDKDMSHPQMPKKIEDAKIAILTCPFEPPKPKTKHKVDIDTVEKFQTLRQQEQKYFDDMVQKCKDVGATLVICQWGFDDEANHLLMHRNLPAVRWVGGVELELIAIATGGRIVPRFQELTPEKLGRAGLVREKSFGTTKDKMLYIEHCANSRAVTIFIRGGNKMMIEETKRSIHDALCVARNLIRNNSIVYGGGSAEISCSIAVEAAADKYPGVEQYAIRAFADALDSVSIALAENSGLQPIETLSAVKSQQIKENNPHFGIDCNDVGTNDMREQNVFETLIGKQQQILLATQVVKMILKIDDVISPSDF

SEQ ID NO: 3895 - protein, 535 aa, Vitis vinifera
MALAFDEFGRPFIILKEQEQKSRLRGLDAQKANISAGKAVARILRTSLGPKGMDKMLQSPDGDVTITNDGATILEQMDVDNQIAKLVVELSRSQDYEIGDGTTGVVVMAGALLEQAERLLERGIHPIRISEGYEMASRIAVEHLEHIAQKFDFGVTNIEPLVQTCMTTLSSKIVNRCKRSLAEIAVKAVMSVADLERKDVNLDLIKVEGKVGGKLEDTELIYGILVDKDMSHPQMPKQIEDAKIAILTCPFEPPKPKTKHKVDIDTVEKFQTLRQQEQKYFDDMVQKCKDVGATLVICQWGFDDEANHLLLHRNLPAVRWVGGVELELIAIATGGRIVPRFQELTQEKLGKAGLVREKSFGTTKDRMLYIEHCANSRAVTIFIRGGNKMMIEETKRSIHDALCVARNLIRSNSIVYGGGSAEISCSIAVEAAADRYPGVEQYAIRAFGDALDSIPMALAENSGLQPIETLSAVKSQQIKEDNPYCGIDCNDVGTNDMQEQNVFETLIGKQQQILLATQVVKMILKIDDVISPSEY

SEQ ID NO: 3896 - protein, 535 aa, Glycine max
MALAFDEFGRPFIILKEQEQKSRLRGLDAQKANISAGKAVARILRTSLGPKGMDKMLQSPDGDVTITNDGATILDQMDVDNQIAKLMVELSRSQDYEIGDGTTGVVVMAGALLEKAERLLERGIHPIRIAEGYEMASRIAVEHLERVANKFEFDESNLEPLIQTCMTTLSSKIVNRCKRSLAEIAVKAVLAVADLARKDVNLDLIKVEGKVGGKLEDTELIYGIVVDKDMSHPQMPKQIEDAKIAILTCPFEPPKPKTKHKVDIDTVEKFQTLRLQEQKYFDDMVQKCKDVGATLVICQWGFDDEANHLLMHRNLPAVRWVGGVELELIAIATGGRIVPRFQELSPEKLGKAGMVREKSFGTTKDRMLYIEHCANSRAVTIFIRGGNKMIIEETKRSLHDALCVARNLIRNNSIVYGGGSAEISCSIAVEAAADRYPGVEQYAIRAFGDALEAIPMALAENSGLQPIETLSAVKSQQIKDNNPHFGIDCNDVGTNDMREQNVFETLIGKQQQLLLATQVVKMILKIDDVISPSEY

SEQ ID NO: 3897 - protein, 535 aa, Olea europaea
MALAFDEYGRPFIILKEQDQKTRLRGLDAQKANISAGKAVARILRTSLGPKGMDKMLQSPDGDVTITNDGATILEQMDVDNQIAKLMVELSRSQDYEIGDGTTGVVVMAGSLLEQAEKLLERGIHPIRIAEGYEMASRIAFEHLENVAHKFEFDATNMEPLIQTCMTTLSSKLVNRCKRSLAEIAVKAVLAVADLERKDVNLDLIKVEGKVGGKLEDTELIYGIVVDKDMSHPQMPKQIEDAKIAILTCPFEPPKPKTKHKVDIDTVEKFQTLRRQEQQYFDDMVQKCKDVGATLVICQWGFDDEANHLLMHRNLPAVRWVGGVELELIAIATGGRIVPRFQELTPEKLGRAGLVREKAFGTTKDRMIYIEHCANSRAVTIFIRGGNKMMIEETKRSLHDALCVARNLIRNNSIVYGGGSSEISCSIAVEAAADKYPGVEQYAIRAFADALDAIPMALAENSGLQPIETLSAVKSQQIKENNNCCGIDCNDIGTNDMREQNVFETLIGKQQQILLATQVVKMILKIDDVISSSDY

SEQ ID NO: 3898 - protein, 535 aa, Malus domestica
MALAFDEYGRPFIILREQEQKSRLRGLDAQKANISAGKAVARILRTSLGPKGMDKMLQSPDGEITVTNDGATILEQMDVDNQIAKLMVELSRSQDYEIGDGTTGVVVLAGALLEHAERLLERGIHPIRVAEGYELASRIAFDHLQHISHKFEFDLDNIEPLVGTCMTTLSSKIVNRCKRDLAEIAVKAVMAVADLERKDVNLDLIKVEGKVGGKLEDTELVYGILIDKDMSHPQMPKHIEDAKIAILTCPFEPPKPKTKHKVDIDTVEKFQTLRLQEQKYFDDMVQKCKDVGATLVICQWGFDDEANHLLMHRNLPAVRWVGGVELELIAIATGGRIVPRFQELTPEKLGKAGIVREKSFGTTKDRMLYIEHCANSKAVTIFIRGGNKMMIEETKRSIHDALCVARNLIRNNSIVYGGGSAEISCSVAVEAAADRYPGVEQYAIRAFADALDAVPMALAENSGLQPIETLSAVKAEQIKENIPYYGIDCNDVGTNDMRKQNVFETLIGKQQQILLATQVVKMILKIDDVISPSDY

SEQ ID NO: 3899 - protein, 535 aa, Unknown
  Sequence found in Organisms: Citrus clementina, Citrus sinensis
MALAFDEFGRPFILLRQQEEKSRLRGLDAQKANVSAGKAVARILRTSLGPKGMDKMLQSPDGDVTITNDGATILEQMDVDNQIAKLMVELSRSQDYEIGDGTTGVVVMAGSLLEQAEKLLERGIHPIRIAEGYEMASRIAVEHLERIAQKFEFGLNDLEPLVQTCMTTLNSKMVNRCKRRLAEIAVKAVLAVADLERKDVNLDLIKVEGKVGGRLEDTELIYGITVDKDMSHPQMPKRIENAKIAILTCPFEPPKPKTKHKVDIDTVEKFQTLRQQEQKYFDDMVQKCKDVGATLVICQWGFDDEANHLLMHRNLPAVRWVGGVELELIAIATGGRIVPRFQELTPEKLGKAGLVREKSFGTTQDRMLYIEHCANSRAVTIFIRGGNKMMIEETKRSIHDALCVARNLIRNNSIVYGGGAAEIACSIAVDAAADRYPGVEQYAIRAFADALDAIPMALAENSGLQPIETLSAVKNQQIRENNPNCGIDCNDVGTNDMREQNVFETLIGKQQQILLATQVVKMILKIDDVISPSEY

SEQ ID NO: 3900 - protein, 535 aa, Gossypium hirsutum
MALAFDEYGRPFIILKEQDQKTRLRGIDAQKANISAGKAVARILRTSLGPKGMDKILQSPDGDVTITNDGATILEQMDVDNQIAKLMVELSRSQDYEIGDGTTGVVVMAGALLEQAERLLERGIHPIRIAEGYEMASRIAVEHLEHISQKFDFGASNIEPLVQTCMTTLSSKIVNRCKRHLAEISVKAVLSVADLERKDVNLDMIKVEGKVGGKLEDTELIYGITVDKDMSHPQMPKQIEDAKIAILTCPFEPPKPKTKHKVDIDTVEKFQTLRLQEQKYFDDMVQKCKDVGATLVICQWGFDDEANHLLMHRNLPAVRWVGGVELELIAIATGGRIVPRFQELTPEKLGRAGLVREKSFGTTKDKMLYIEHCANSRAVTIFIRGGNKMMIEETKRSIHDALCVARNLIRNNSIVYGGGSAEISCSIAVEAAADKYPGVEQYAIRAFADALDSVPMALAENSGLQPIETLSAVKSQQIKDNNPHYGIDCNDVGTNDMREQDVFETLIGKQQQILLATQVVKMILKIDDVISPSDY

SEQ ID NO: 3901 - protein, 535 aa, Glycine max
MALAFDEFGRPFIILKEQEQKSRLRGLDAQKANISAGKAVARILRTSLGPKGMDKMLQSPDGDVTITNDGATILDQMDVDNQIAKLMVELSRSQDYEIGDGTTGVVVMAGALLEKAERLLERGIHPIRIAEGYEMASRIAVEHLERVANKFEFDESNLEPLIQTCMTTLSSKIVNRCKRSLAEIAVKAVLAVADLARKDVNLDLIKVEGKVGGKLEDTELIYGIVVDKDMSHPQMPKQIEDAKIAILTCPFEPPKPKTKHKVDIDTVEKFQTLRLQEQKYFDDMVQKCKDVGATLVICQWGFDDEANHLLMHRNLPAVRWVGGVELELIAIATGGRIVPRFQELSPEKLGKAGMVREKSFGTTKDRMLYIEHCANSRAVTIFIRGGNKMIIEETKRSLHDALCVARNLIRNNSIVYGGGSAEISCSIAVEAAADRYPGVEQYAIRAFGDALEAIPMALAENSGLQPIETLSAVKSQQIKDNNPHFGIDCNDVGTNDMREQNVFETLIGKQQQLLLATQVVKMILKIDDVISPYEY

SEQ ID NO: 3902 - protein, 535 aa, Amborella trichopoda
MALAFDEYGRPFIILKEQEQMNRLRGLDAQKANISAGKAVARILRTSLGPKGMDKMLQSPDGEVTITNDGATILEQMDVDNQIAKLMVELSRSQDYEIGDGTTGVVVMAGALLEQAERLLECGIHPIRIAEGYEMASRMAVDHLEKISKTFEFSLTNIESLVQTCMTTLSSKIVNRCKRSLAEIAVKAVLAVADLDRKDVNLDLIKVEGKVGGKLEDTELVYGITVDKDMSHPQMPKRIENAKIAILTCPFEPPKPKTKHKVDIDTVEKFQTLRKQEQQYFDDMVQRCKDVGATLVICQWGFDDEANHLLMNRGLPAVRWVGGVELELIAIATGGRIVPRFQELTPEKLGKAGIVREKSFGTTKDRMLYIEQCANSRAVTIFIRGGNKMMIEETKRSLHDALCVARNLIRNNSIVYGGGSAEISCSIAVEAAADRIPGVEQYAIRAFADALDSIPMALAENSGLQPIETLTAVKSQQVKEGNPHYGIDCNDIGTNDMLQQDVFETLIGKQQQILLATQVVKMILKIDDVISPADY

SEQ ID NO: 3903 - protein, 535 aa, Amsonia hubrichtii
MALAFDEFGRPFIIIKEQEQKTRLRGLDAQKANISAGKAIARILRTSLGPKGMDKMLQSPDGDVTITNDGATILEQMDVDNQIAKLMVELSRSQDYEIGDGTTGVVVMAGALLDQAERLLERGIHPIRVAEGYEVASRIAFEHLERIAHKYEFDANNVEPLIQTCMTTLSSKIVNRCKHSLAEIAVKAVLAVADLERKDVNLDLIKVEGKVGGKLEDTELIYGIVVDKDMSHPQMPKEIQDAKIAILTCPFEPPKPKTKHKVDIDTVEKFQTLRHQELKYFDDMVQQCKDVGATLVICQWGFDDEANHLLMHRNLPAVRWVGGVELELIAIATGGRIVPRFQELTPEKLGKAGLVREKSFGTTKDRMIYIEHCANSRAVTIFIRGGNKMMIEETKRSIHDALCVARNLIRNNSIVYGGGSAEISCSVAVEAAADKYSGVEQYAIRAFADALDSIPMALAENSGLQPIETLSAVKSQQIKENNPCCGIDCNDVGTNDMREQNVFETLIGKQQQILLATQVVKMILKIDDVISPSEY

SEQ ID NO: 3904 - protein, 535 aa, Malus domestica
MALAFDEYGRPFIILREQEQKSRLRGLDAQKANISAGKAVARILRTSLGPKGMDKMLQSPDGEITVTNDGATILEQMDVDNQIAKLMVELSQSQDYEIGDGTTGVVVLAGALLEHAERLLERGIHPIRVAEGYELASRIAVDHLQHISHKFEFGLDNIEPLVGTCMTTLSSKIVNRCKRALAEIAVKAVLAVADLERKDVNLDLIKVEGKVGGKLEDTELVYGILIDKDMSHPQMPKYIENAKIAILTCPFEPPKPKTKHKVDIDTVEKFQTLRMQEQKYFDDMVQKCKDVGATLVICQWGFDDEANHLLMHRNLPAVRWVGGVELELIAIATGGRIVPRFQELTPEKLGKAGIVREKSFGTTKDRMLYIEHCANSRAVTIFIRGGNKMMIEETKRSIHDALCVARNLIRNNSIVYGGGSAEISCSVAIEAAADRYPGVEQYAIRAFADALDAVPMALAENSGLQPIETLSAVKAEQIKENIPYYGIDCNDVGTNDMRKQNVFETLIGKQQQILLATQVVKMILKIDDVISPSDY

SEQ ID NO: 3905 - protein, 535 aa, Aquilegia formosa
MALAFDEYGRPFIILREQEQKSRLRGLDAQKANISAGKAVARILRTSLGPKGMDKMLQSPDGDVTITNDGATILDQMDVDNQIAKLMVELSRSQDYEIGDGTTGVVVLAGALLEQAERLLERGVHPIRVAEGYEMASRIAVDHLEHIAQKFEFDAANIEPLVQTCMTTLSSKIVNRCKRSLAEIAVKAVVSVADLERRDVNLDLIKVEGKVGGKLEDTELINGIIVDKDMSHPQMPKQIQNAKIAILTCPFEPPKPKTKHKVDIDSVEKFQTLRLQEQKYFDDMVQKCKDVGATLVICQWGFDDEANHLLMHRNLPAVRWVGGVELELIAIATGGRIVPRFQELTTEKLGKAGLVREKSFGTTKERMLYIEECANSRAVTIFIRGGNKMMIEETKRSVHDALCVARNLIRNNSIVYGGGSAEISCSIAVEAAADKYPGVEQYAIRAFADALEAVPMALAENSGLQPIETVSAVKSQQVKENNSYCGIDCNDVGTNDMREQNVFETLIGKQQQLLLATQVVKMILKIDDIISPSEY

SEQ ID NO: 3906 - protein, 535 aa, Unknown
  Sequence found in Organisms: Centaurea maculosa, Cirsium arvense
MALAFDEYGRPFIILREQESKSRLRGLDAQKANISAGVAVARILRTSLGPKGMDKMLQSPDGDITITNDGATILEQMDVDNQIGKLMVELSRSQDYEIGDGTTGVVVMAGALLEQAERLLERGIHPIRVAEGYEIASKIAVDHLQQIAHKFEFTATHIEPLVQTCMTTLSSKIVNRCKRSLAEIAVKAVMAVADLERKDVNLDLIKVEGKVGGKLEDTELIYGILVDKDMSHPQMPKQIEDAKIAILTCPFEPPKPKTKHKVDIDTVEKFQTLRQQEQKYFDDMVQQCKDVGATLVICQWGFDDEANHLLMHRNLPAVRWVGGVELELIAIATGGRIVPRFQELTPEKLGKAGLVREKAFGTTKDRMLYIEHCANSRAVTIFIRGGNKMMIEETKRSLHDALCVARNLIRNNNIVYGGGAAEISCSIAVEAAADKYPGVEQYAVRAFADALDSVPMALAENSGLQPIETLSAVKSQQIKDNNPFCGIDCNDAGTNDMREQNVFETLIGKQQQLLLATQVVKMILKIDDVISPTEY

SEQ ID NO: 3907 - protein, 535 aa, Cichorium intybus
MALAFDKYGRPFIILREQESKSRLRGLDAQKANIAAGVAVSRILRTSLGPKGMDKMLQSPDGDITITNDGATILEQMDVDNQIGKLMVELSRSQDYEIGDGTTGVVVLAGALLEQAEKLLERGIHPIRVAEGFEISSRIAVDHLEQISHKFDFNATNIEPLVQTCMTTLSSKIVNRCKRSLAEIAVKAVMAVADLERKDVNLDLIKVEGKVGGKLEDTELIYGIIVDKDMSHPQMPKQIEDAKIAILTCPFEPPKPKTKHKVDIDTVEKFQTLRKQEQKYFDDMVQRCKDVGATLVICQWGFDDEANHLLMHRNLPAVRWVGGVELELIAITTGGRIVPRFQELTTEKLGKAGLVREKSFGTTKDRMLYIEHCANSRAVTVFIRGGNKMMIEETKRSIHDALCVARNLIRNNSIVYGGGAAEISCSIAVEAAADKYPGVEQYAIRAFADALDSVPMALAENSGLSCIETLSAVKAQQIKENNHCCGIDCNDTGTNDMREQNVFETLIGKQQQILLATQVVKMILKIDDVISPSEY

SEQ ID NO: 3908 - protein, 535 aa, Vigna unguiculata
MALAFDEFGRPFIILKEQEQKSRLRGLDAQKSNISAGKAVARILRTSLGPKGMDKMLQSPDGDVTITNDGATILEQMDVDNQIAKLMVELSRSQDYEIGDGTTGVVVMAGALLEKAERLLERGIHPIRIAEGYETASRIAVEHLERVANKFEFGESNLEPLIQTCMTTLSSKIVNRCKRSLAEIAVKAVLAVADLERKDVNLDLIKVEGKVGGKLEDTELIYGIVVDKDMSHPQMPKQIEDAKIAILTCAFEPPKPKTKHKVDIDTVEKFQTLRLQEQKYFDDMVQKCKDVGATLVICQWGFDDEANHLLMHRNLPAVRWVGGVELELIAIATGGRIVPRFQELSTEKLGKAGMVREKSFGTTKDRMLYIEHCANSRAVTIFIRGGNKMIIEETKRSLHDALCVARNLIRNNSIVYGGGSAEISCSIAVEAAADKYPGVEQYAIRAFGDALEAIPMALAENSGLQPIETLSAVKSQQIKDNNPHFGIDCNDVGTNDMREQNVFETLIGKQQQILLATQVVKMILKIDDVISPSEY

SEQ ID NO: 3909 - protein, 535 aa, Eschscholzia californica
MALAFDDYGRPFIILREQEQKSRLKGLDAQKANISAGKAVARILRTSLGPKGMDKILQSPDGDVTITNDGATILELMDVDNQIAKLMVDLSQSQDYEIGDGTTGVVVMAGALLEQAEHLLERGIHPVRVAEGYEMASRVAVEHLERISNKFNFSASDIEPLVQTCMTTLSSKIVNRCKRSLAEIAVRAVLAVADLERKDVNLDMIKVEGKVGGKLEDTELIYGITVDKDMSHPQMPKEIRDANIAILTCPFEPPKPKTKHKVDIDSVEKFQTLRLQEQKYFDDMVQKCKDVGATLVICQWGFDDEANHLLMHRNLPAVRWVGGVELELIAIATGGRIVPRFQELTTEKLGKAGLVREKSFGTTKDRMLYIEHCANSRAVTIFIRGGNKMMIEETKRSLHDALCVARNLIRNNSIVYGGGSAEISCSIAVEAAADKYPGVEQYAIRAFADALDSIPMALAENSGLQPIETLSLVKAQQIKENNPCCGIDCNDVGTNDMREQNVFETLIGKQQQILLATQVVKMILKIDDVISPSEY

SEQ ID NO: 3910 - protein, 535 aa, Eschscholzia californica
MALAFDDYGRPFIILREQEKTSRLKGLDAQKANISAGKAVARILRTSLGPKGMDKILQSPDGDVTITNDGATILELMDVDNQIAKLMVDLSQSQDYEIGDGTTGVVVMAGALLEQAEHLLERGIHPVRVAEGYEMASRVAVEHLEHISNKFNFSATDIEPLVQTCMTTLSSKIVNRCKRSLAEIAVKAVLAVADLERKDVNLDLIKVEGKVGGKLEDTELINGIIVDKDMSHPQMPKQIQDAKIAILTCPFEPPKPKTKHKVDIDTVEKFQTLRLQERKYFDDMVKQCKDVGATLVICQWGFDDEANHLLMNHNLPAVRWVGGVELELIAIATGGRIVPRFQELTPEKLGKAGLVREKSFGTTKDRMLYIEKCANSRAVTIFIRGGNKMMIEETKRSLHDALCVARNLIRNNSIVYGGGSAEISCSIAVEAAADKYPGVEQYAIRAFADALDSIPMALAENSGLQPIETLSAVKSQQIKESNPCCGIDCNDVGTNDMREQNVFETLIGKQQQILLATQVVKMILKIDDVISPSEY

SEQ ID NO: 3911 - protein, 535 aa, Cajanus cajan
MALAFDEFGRPFIILKEQEQKSRLRGLDAQKSNISAGKAVARILRTSLGPKGMDKMLQSPDGDVTITNDGATILEQMDVDNQIAKLMVELSRSQDYEIGDGTTGVVVLAGALLEKAERLLERGIHPIRIAEGYEMASRIAVEHLERVANKFEFDDTNLEPLIQTCMTTLSSKIVNRCKRSLAEIAVKAVLAVADLERKDVNLDLIKVEGKVGGKLEDTELIYGIVVDKDMSHPQMPKQIEDAKIAILTCPFEPPKPKTKHKVDIDTVEKFQTLRLQEQKYFDDMVQKCKDVGATLVICQWGFDDEANHLLMHRNLPAVRWVGGVELELIAIATGGRIVPRFQELSTEKLGKAGMVREKSFGTTKDRMLYIEHCANSRAVTIFIRGGNKMIIEETKRSLHDALCVARNLIRNKSIVYGGGSAEIACSIAVEAAADRYPGVEQYAIRAFGDALEAIPMALAENSGLQPIETLSAVKAQQIKDNNPHFGIDCNDVGTNDMREQNVFETLIGKQQQLLLATQVVKMILKIDDVISPSEY

SEQ ID NO: 3912 - protein, 535 aa, Secale cereale
MALAFDDFGRPFIILREQESKSRLRGLDAHKANVAAGKAIARSLRTSLGPKGMDKILQSPDGDVTITNDGATILEQMDVDNQIAKLMVELSRSQDYEIGDGTTGVVVLAGSLLEQAEKLLERGIHPIRIAEGYEMASKLAFDHLERISTRFEFTAANIEPLVQTCVTTLSSKIVNRCKRMLAEIAVRAVLAVADLERKDVNLDLIKVEGKVGGKLEDTELIYGIAVDKDMSHPQMPKRIEDANIAILTCPFEPPKPKTKHKVDIDTIEKFQTMRGQEQKYFDEMVQKCKDVGATLVICQWGFDDEANHLLMQRNLPAVRWVGGVELELIAIATGGRIVPRFQELTPDKLGQAGLVREKSFGTTKDRMLYIERCANSRAVTILIRGGNKMMIEEAKRSIHDALCVARNLIRNNSIVYGGGSAEISCSIAVEAAADRYAGAEQYAIRSFADALDGIPLALAENSGLPPIDTLTAVKYQQIQENNPYCGIDCNDVGTNDMREQNVFETLIGKQQQILLATQVVKMILKIDDVITPSEF

SEQ ID NO: 3913 - protein, 535 aa, Triphysaria pusilla
MALAFDEYGRPFIILREQEQKTRLRGLDAQKSNISAGKAVARILRTSLGPKGMDKMLQSPDGDITITNDGATILEQMDVDNQIGKLMVELSRSQDYEIGDGTTGVVVMAGALLEQAEKLLERGIHPIRIAEGYEVASRIAYEHLENISHKFVFGATDIEPLIQTCMTTLSSKIVNRCKRSLAEIAVKAVVAVADLERKDVNLDLIKVEGKVGGKLEDTELIYGIVVDKDMSHPQMPKQIQDANIAILTCPFEPPKPKTKHKVDIDTVEKFQTLREQERKYFDNMVQQCKDVGATLVICQWGFDDEANHLLMNRNLPAVRWVGGVELELIAIATGGRIVPRFQELTPEKLGKAGLVREKAFGTTKDRMIYIEHCANSRAVTIFIRGGNKMMIEETKRSIHDALCVARNLIRNNSIVYGGGSAEIACSIAVEAAADKHPGVEQYAIRAFADALDAIPMALAENSGLQPIETLSAVKSQQIKENNSCCGIDCNDVGTNDMREQNVFETLIGKQQQLLLATQVVKMILKIDDVISPSEY

SEQ ID NO: 3914 - protein, 535 aa, Mimulus guttatus
MALAFDEYGRPFIILREQDQKTRLRGLDAQKANIAAGKAVARILRTSLGPKGMDKMLQSPDGEVTITNDGATILEQMDVDNQIGKLMVELSRSQDYEIGDGTTGVVVMAGSLLEQAEKLLERGIHPIRIAEGYEVASRIAFEHLEQIANKFEFSAANVEPLIQTCMTTLSSKIVNRCKRSLAEIAVKAVLAVADLERRDVNLDLIKVEGKVGGKLEDTELIYGIIVDKDMSHPQMPKQIVDANIAILTCPFEPPKPKTKHKVDIDTVEKFQTLRQQEQKYFDDMVQKCKDVGATLVICQWGFDDEANHLLMNRDLPAIRWVGGVELELIAIATGGRIVPRFQELTTEKLGKAGLVREKAFGTTKDRMIYIEHCANSRAVTIFIRGGNKMMIEETKRSIHDALCVARNLIRNKSIVYGGGSAEISCSIAVEAAADKYPGVEQYAIRAFADALDAIPMALAENSGLQPIETLSAVKSQQIKENNSYCGIDCNDVGTNDMREQNVFETLIGKQQQILLATQVVKMILKIDDVISPSDY

SEQ ID NO: 3915 - protein, 535 aa, Ambrosia trifida
MALAFDEYGRPFIILREQESKTRLRGIDAQKANISAGVAVSRILRTSLGPKGMDKMLQSPDGDITITNDGATILEQMDVDNQIGKLMVELSRSQDYEIGDGTTGVVVLAGALLEQAEKLLERGIHPIRVAEGFEISSKMAVDHLEKISHKFDFSASNIEPLVQTCMTTLSSKIVNRCKRSLAEIAVKGVMAVADLERKDVNLDLIKVEGKVGGKLEDTELIYGIVVDKDMSHPQMPKQIEDAKIAILTCPFEPPKPKTKHKVDIDTVEKFQTLRKQEQQYFDEMVQKCKDVGATLVICQWGFDDEANHLLMHRNLPAVRWVGGVELELIAIATGGRIVPRFQELTTEKLGKAGLVREKAFGTTKDRMLYIEHCANSKAVTIFIRGGNKMMIEETKRSIHDALCVARNLIRNNSIVYGGGAAEISCSIAVEAAADKYPGVEQYAIRAFADALDSVPMALAENSGLQPIETVSAVKAQQIKENNHCCGIDCNDTGTNDMREQNVFETLIGKQQQILLATQVVKMILKIDDVISPSEY

SEQ ID NO: 3916 - protein, 535 aa, Ambrosia trifida
MALAFDEYGRPFIILREQESKTRLRGIDAQKANISAGVAVSRILRTSLGPKGMDKMLQSPDGDITITNDGATILEQMDVDNQIGKLMVELSRSQDYEIGDGTTGVVVLAGALLEQAEKLLERGIHPIRVAEGFEISSKMAVDHLEKISHKFDFSASNIEPLVQTCMTTLSSKIVNRCKRSLAEIAVKGVMAVADLERKDVNLDLIKVEGKVGGKLEDTELIYGIIVDKDMSHPQMPKQIEDAKIAILTCPFEPPKPKTKHKVDIDTVEKFQTLRKQEQQYFDDMVQKCKDVGATLVICQWGFDDEANHLLMHRNLPAVRWVGGVELELIAIATGGRIVPRFQELTTEKLGKAGLVREKAFGTTKDRMLYIEHCANSKAVTVFIRGGNKMMIEETKRSIHDALCVARNLIRNNSIVYGGGAAEISCSIAVEAAADKYPGVEQYAIRAFADALDSVPMALAENSGLQPIETLSAVKAQQIKENNHCCGIDCNDTGTNDMREQNVFETLIGKQQQILLATQVVKMILKIDDVISPSEY

SEQ ID NO: 3917 - protein, 535 aa, Arnica chamissonis
MALAFDEYGRPFIILREQESKSRLRGLDAQKANIAAGVAVSRILRTSLGPKGMDKMLQSPDGDITITNDGATILEQMDVDNQIGKLMVELSRSQDYEIGDGTTGVVVMAGSLLEQAEKLLERGIHPIRVAEGFEISSRIAVDHLEQIAHKFNFSATDIEPLVQTCMTTLSSKIVNRCKRSLAEIAVKSVMAVADLERKDVNLDLIKVEGKVGGKLEDTELIYGIIVDKDMSHPQMPKQIEDAKIAILTCPFEPPKPKTKHKVDIDTVEKFQTLRKQEQKYFDDMVQKCKDVGATLVICQWGFDDEANHLLMHRNLPAVRWVGGVELELIAIATGGRIVPRFQELTPEKLGKAGLVREKAFGTTKDRMLYIEHCANSKAVTVFIRGGNKMMIEETKRSIHDALCVARNLIRNNSIVYGGGAAEISCSIAVEAAADKYPGVEQYAIRAFADALDSVPMALAENSGLQPIETLSAVKAQQIKEKNDCCGIDCNDTGTNDMRAQNVFETLIGKQQQILLATQVVKMILKIDDVISPSDY

SEQ ID NO: 3918 - protein, 535 aa, Musa acuminata
MALAFDEYGRPFIIIKEQGQKARLRGLEAQKANISAGKAVARILRTSLGPKGMDKMLQSPDGDVIVTNDGATILEQMDVDNQIGKLMVELSRSQDYEIGDGTTGVVVLAGALLEQAEKLLERGIHPIRIAEGYEMASRLAVDHLEHISQKFEFSVTNIEPLVQTCMTTLSSKIVNRCKRALAEIAVKAVLAVADLERKDVNLELIKVEGKVGGKLEDTELIYGIVVDKDMSHPQMPKRIEEAKIAILTCPFEPPKPKTKHKIDIDTVEKFQTLRQQEQKYFDDMVQKCKDVGATLVICQWGFDDEANHLLMHRNLPAVRWVGGVELELIAIATGGRIVPRFQDLTDEKLGKAGLVREKSFGTTKDRMLYIEHCANSRAVTIFIRGGNKMMIDETKRSLHDALCVARNLIRSNSIVYGGGSAELSCSIAVEAAADKYPGVEQYAIRSFAEALDFIPMALAENCGLPPIDTVTAVKSQQIKENNPYCGIDCNDVGTNNMMEQNVFETLIGKQQQILLATQVVKMILKIDDVITPSAY

SEQ ID NO: 3919 - protein, 535 aa, Vaccinium corymbosum
MALAFDEYGRPFIIIKEQEQKTRLRGIDAQKANISAGKSVARILRTSLGPKGMDKMLQSPDGEVTITNDGATILEQMDVDNQIAKLMVELSRSQDYEIGDGTTGVVVMAGALLEQAERLLERGIHPIRVAEGYEMASRIAVEHLERIANKFEFSSTNVEPLVQTCMTTLSSKIVNRCKRSLAEIAVNAVLAVADLDRKDVNLELIKVEGKVGGKLEDTELIKGIIVDKDMSHPQMPKHIEDAKIAILTCPFEPPKPKTKHKVDIDTVEKFQNLRGQEQKYFDDMVQKCKDVGATLVICQWGFDDEANHLLMHRNLPAVRWVGGVELELIAIATGGRIVPRFQELTPEKLGKAGLVREKSFGTTKDRMIYIEHCANSRAVTIFIRGGNKMMIEETKRSIHDALCVARNLIRNNSIVYGGGAAEISCSLAVEAAADRHPGVEQYAIRAFAEALDSIPMALAENSGLQPIETLSAVKSQQIKENNTCCGIDCNDVGTNDMREQNVFETLIGKQQQILLATQVVKMILKIDDVISPSEY

SEQ ID NO: 3920 - protein, 535 aa, Trigonella foenum-graecum
MALAFDEFGRPFIILREQESKNRLRGLDAQKANISAGKAVARILRTSLGPKGMDKMLQSPDGDVIISNDGATILEQMDVDNQIAKLMVELSRSQDYEIGDGTTGVVVLAGSLLEQAERLLERGIHPIRIAEGYEMASRIAVENLEKIANKFEFGETILEPLIQTCMTTLSSKIVNRCKRSLAEIAVKAVLAVADLQRKDVNLDLIKVEGKVGGKLEDTELVYGIIVDKDMSHPQMPKQIEDAKIAILTCPFEPPKPKTKHKVDIDTVEKFQTLRKQEQKYFDDMVQQCKDVGATLVICQWGFDDEANHLLMHRNLPAVRWVGGVELELIAIATGGRIVPRFQELTAEKLGKAGIVREKAFGTTKDRMLYIEHCANSRAVTIFIRGGNKMIIEETKRSIHDALCVARNLIRNNSIVYGGGSAEIACSIAVEAAADRYPGVEQYAIRAFGDALESIPMALAENSGLQPIETLSAVKSQQITEKNPHFGIDCNDVGTNDMREQNVFETLIGKQQQILLATQVVKMILKIDDVISPSEY

SEQ ID NO: 3921 - protein, 535 aa, Triphysaria pusilla
MALAFDEYGRPFIILREQEQKTRLRGLDAQKSNISAGKAVARILRTSLGPKGMDKMLQSPDGDITITNDGATILEQMDVDNQIGKLMVELSRSQDYEIGDGTTGVVVLAGALLEQAERLLERGIHPIRIAEGYEVASRIAFEHLENISHKFVFGATDIEPLIQTCMTTLSSKIVNRCKRNLAEIAVKAVVAVADLERKDVNLDLIKVEGKVGGKLEDTELIYGIVVDKDMSHPQMPKQIQDAKIAILTCPFEPPKPKTKHKVDIDTVEKFQTLREQERKYFDNMVQLCKDVGATLVICQWGFDDEANHLLMNRNLPAVRWVGGVELELIAIATGGRIVPRFQELTPEKLGKAGLVREKAFGTTKDRMIYIEHCANSRAVTIFIRGGNKMMIEETKRSIHDALCVARNLIRNNSIVYGGGSAEIACSIAVEAAADKYPGVEQYAIRAFADALDAIPMALAENSGLQPIETLSAVKSQQIKENNSCCGIDCNDVGTNDMREQNVFETLIGKQQQLLLATQVVKMILKIDDVISPSEY

SEQ ID NO: 3922 - protein, 472 aa, Arnica chamissonis
MALAFDEYGRPFIILREQESKSRLRGLDAQKANIAAGVAVSRILRTSLGPKGMDKMLQSPDGDITITNDGATILEQMDVDNQIGKLMVELSRSQDYEIGDGTTGVVVMAGALLEQAEKLLERGIHPIRVAEGFEISSRIAVDHLEQIAHKFDFSGTNIEPLVQTCMTTLSSKIVNRCKRSLAEIAVKSVMAVADLERKDVNLDLIKVEGKVGGKLEDTELIYGIIVDKDMSHPQMPKQILDAKIAILTCPFEPPKPKTKHKVDIDTVEKFQTLRKQEQKYFDDMVQKCKDVGATLVICQWGFDDEANHLLMHRNLPAVRWVGGVELELIAIATGGRIVPRFQELTPEKLGKAGLVREKAFGTTKDRMLYIEHCANSKAVTIFIRGGNKMMIEETKRSIHDALCVARNLIRNNSIVYVGGLQKFHAQLQLKLLLINIQELNSMPSGLLPMLWILSPWLLLRIVVCNPLKHCLQ

SEQ ID NO: 3923 - protein, 366 aa, Orobanche aegyptiaca
MALAFDEYGRPFIIIREQEHKTRLRGLDAQKSNISAGKAVARILRTSLGPKGMDKMLQSPDGDVTITNDGATILEQMDVDNQIAKLMVELSRSQDYEIGDGTTGVVVMAGALLEQAEKLLERGIHPIRIAEGYEVASRIAFEHLERIANKYEFDAANIEPLIQTCMTTLSSKIVNRCKRSLGEIAVKAVLAVADLERKDVNLELIKVDGKVGGKLEDTELIYGIVVDKDMSHPQMPKQIEDAKIAILTCPFEPPKPKTKHKVDIDTVEKFQTLREQERKYFDDMVQQCKDAGATLVICQWGFDDEANHLLMNRNLPAVRWVGGVELELIAIATGGRIVPRFQELTPEKLGKAGLVREKLLEPLKIV

SEQ ID NO: 3924 - protein, 535 aa, Ambrosia trifida
MALAFDEYGRPFIILREQESKTRLRGIDAQKANISAGVAVSRILRTSLGPKGMDKMLQSPDGDITITNDGATILEQMEVDNQIGKLMVELSRSQDYEIGDGTTGVVVLAGALLEQAEKLLERGIHPIRVAEGFEISSKMAVDHLEKISHKFDFSASNIEPLVQTCMTTLSSKIVNRCKRSLAEIAVKGVMAVADLERKDVNLDLIKVEGKVGGKLEDTELIYGIIVDKDMSHPQMPKQIEDAKIAILTCPFEPPKPKTKHKVDIDTVEKFQTLRKQEQQYFDDMVQKCKDVGATLVICQWGFDDEANHLLMHRNLPAVRWVGGVELELIAIATGGRIVPRFQELTTEKLGKAGLVREKAFGTTKDRMLYIEHCANSKAVTVFIRGGNKMMIEETKRSIHDALCVARNLIRNNSIVYGGGAAEISCSIAVEAAADKYPGVEQYAIRAFADALDSVPMALAENSGLQPIETLSAVKAQQIKENNHCCGIDCNDTGTNDMREQNVFETLIGKQQQILLATQVVKMILKIDDVISPSEY

SEQ ID NO: 3925 - protein, 535 aa, Euonymus alatus
MALAFDEFGRPFIIIKDQEQKSRLRGIDAQKSNISAGKAVARILRTSLGPKGMDKMLQSPDGDVTITNDGATILEQMDVDNQIAKLMVELSRSQDYEIGDGTTGVVVLAGALLEQAERLLERGIHPIRVAEGYEMASRIAFEHLGHIAEKFEFELSNLEPLIQTCMTTLSSKIVNRNKRSLAEIAVKAVTAVADLERKDVNLDLIKVEGKVGGKLEDTELIYGIIVDKDMSHPQMPKQIEDAKIAILTCPFEPPKPKTKHKVDIDTVEKFQTLRQQEQKYFDDMVQQCKDVGATLVICQWGFDDEANHLLMHRNLPAVRWVGGVELELIAIATGGRIVPRFQELTPEKLGKAGLVREKSFGTTKDRMLYIEHCANSRAVTIFIRGGNKMMIEETKRSIHDALCVARNLIINNSIVYGGGSAEIACSIAVEAASDRHPGVEQYAIRAFADALDSVPMALAENSGLQPIETLSAVKSQQIKENNPYCGIDCNDVGTNDMRQQNVFETLIGKQQQILLATQVVKMILKIDDVISPSDF

SEQ ID NO: 3926 - protein, 535 aa, Gossypium raimondii
MALAFDEYGRPFIILKEQEQKTRLSGLEAQKANISAGRAVSRILRTSLGPKGMDKMLQSPDGDVTITNDGATILEQMDVDNQIAKLMVELSRSQDYEIGDGTTGVVVMAGALLEQAERLLERGIHPIRIAEGYEMASRIAVEHLECIAQKFDFGPTNIEPLVQTCMTTLSSKIVNRCKRALAEISVKAVLSVADLERKDVNLDLIKVEGKVGGKLEDTELIYGITVDKDMSHPQMPKQIEDAKIAILTCPFEPPKPKTKHKVDIDTVEKFQTLRQQEQKYFDDMVQKCKEVGATLVICQWGFDDEANHLLMHQNLPAVRWVGGVELELIAIATGGRIVPRFQELTPEKLGRAGLVRERSFGTTKDKMLYIEHCANSRAVTIFIRGGNKMMIEETKRSIHDALCVARNLIRNNFIVYGGGAAEISCSIAVEAAADKYPGVEQYAIRAFADALDAVPVALAENSGLQPIETLSAVKSQQIKENNPHFGIDCNDVGTNDMCEQNVFETLIGKQQQILLATQVVKMILKIDDVISPSDY

SEQ ID NO: 3927 - protein, 535 aa, Medicago truncatula
MALAFDEYGRPFIILREQESKNRLRGLDAQKANISAGKAVARILRTSLGPKGMDKMLQSPDGDVIISNDGATILEQMDVDNQIAKLMVELSRSQDYEIGDGTTGVVVLAGSLLEQAERLLERGIHPIRIAEGYEMASRIAVENLEKIANKFEFGETILEPLIQTCMTTLSSKIVNRCKRSLAEIAVKAVLAVADLERKDVNLDLIKVEGKVGGKLEDTELVYGIIVDKDMSHPQMPKQIEDAKIAILTCPFEPPKPKTKHKVDIDTVEKFQTLRKQEQKYFDDMVQQCKDVGATLVICQWGFDDEANHLLMHRNLPAVRWVGGVELELIAIATGGRIVPRFQELTAEKLGKAGIVREKAFGTTKDRMLYIEHCANSRAVTIFIRGGNKMIIEETKRSIHDALCVARNLIRNNSIVYGGGSAEIACSIAVEAAADRYPGVEQYAIRAFGDALESIPMALAENSGLQPIETLSSVKSQQITEKNPHFGIDCNDVGTNDMREQNVFETLIGKQQQILLATQVVKMILKIDDVISPSEY

SEQ ID NO: 3928 - protein, 535 aa, Picea glauca
MALAFDEFGRPFIIIREQEQKTRIRGLDAQKANISAARAVARILRTSLGPKGMDKMLQSPDGDVTITNDGATILEQMDVENQIGKLMVELSRSQDYEIGDGTTGVVVTAGALLEHAEQLLERGIHPIRIAEGYEMASKIAVEHLDRISQKFEFSLNNIESLVQTCMTTLSSKIVNRCKHMLAEIAVKAVLAVADLERKDVNLDLIKVEGKVGGKLEDTELVYGIIVDKDMSHPQMPKRIEDVNIAILTCPFEPPKPKTKHKVDIDSVEKFEALREQEKHYFDEMVKKCKDVGATLVICQWGFDDEANHLLMHRGLPAVRWVGGVELELIAIATGGRIVPRFQELTPEKLGKAGLVREKAFGTTKDRMLYIEQCANSRAVTIFIRGGNKMMIEETKRSLHDALCVARNLIRDNSIVYGGGSAEISCSLAVEAAADKIPGVEQYAVRAFADALDAVPMALAENSGLQPIDTLTAVKAQQIRESNPHLGIDCNDVGTNDMKAQNVFETLMGKKQQLLLATQVVKMILKIDDVITPSGY

SEQ ID NO: 3929 - protein, 535 aa, Picea glauca
MALAFDEFGRPFIIIREQEQKTRIRGLDAQKANISAARAVARILRTSLGPKGMDKMLQSPDGDVTITNDGATILEQMDVENQIGKLMVELSRSQDYEIGDGTTGVVVTAGALLEHAEQLLERGIHPIRIAEGYEMASKIAVEHLDRISQKFEFSLNNIESLVQTCMTTLSSKIVNRCKRMLAEIAVKAVLAVADLERKDVNLDLIKVEGKVGGKLEDTELVYGIIVDKDMSHPQMPKRIEDVNIAILTCPFEPPKPKTKHKVDIDSVEKFEALREQEKQYFDEMVKKCKDVGATLVICQWGFDDEANHLLMHRGLPAVRWVGGVELELIAIATGGRIVPRFQELTPEKLGKAGLVREKAFGTTKDRMLYIEQCANSRAVTIFIRGGNKMMIEETKRSLHDALCVARNLIRDNSIVYGGGSAEISCSLAVEAAADKIPGVEQYAVRAFADALDAVPMALAENSGLQPIDTLTAVKAQQIRESNPHLGIDCNDVGTNDMKAQNVFETLMGKKQQLLLATQVVKMILKIDDVITPSGL

SEQ ID NO: 3930 - protein, 535 aa, Picea glauca
MALAFDEFGRPFIIIREQEQKTRIRGLDAQKANISAARAVARILRTSLGPKGMDKMLQSPDGDVTITNDGATILEQMDVENQIGKLMVELSRSQDYEIGDGTTGVVVTAGALLEHAEQLLERGIHPIRIAEGYEMASKIAVEHLDRISQKFEFSLNNIESLVQTCMTTLSSKIVNRCKRMLAEIAVKAVLAVADLERKDVNLDLIKVEGKVGGKLEDTELVYGIIVDKDMSHPQMPKRIEDVNIAILTCPFEPPKPKTKHKVDIDSVEKFEALREQEKHYFDEMVKKCKDVGATLVICQWGFDDEANHLLMHRGLPAVRWVGGVELELIAIATGGRIVPRFQELTPEKLGKAGLVREKAFGTTKDRMLYIEQCANSRAVTIFIRGGNKMMIEETKRSLHDALCVARNLIRDNSIVYGGGSAEISCSLAVEAAADKIPGVEQYAVRAFADALDAVPMALAENSGLQPIDTLTAVKAQQIRESNPHLGIDCNDVGTNDMKAQNVFETLMGKKQQLLLATQVVKMILKIDDVITPSGL

SEQ ID NO: 3931 - protein, 535 aa, Phaseolus vulgaris
MALAFDEFGRPFIILKEQEQKSRLRGLDAQKSNISAGKAVARILRTSLGPKGMDKMLQSPDGDVTITNDGATILEQMDVDNQIAKLMVELSRSQDYEIGDGTTGVVVMAGALLEKAERLLERGIHPIRIAEGYETASRISVEHLDRVANKFEFGESNLEPLIQTCMTTLSSKIVNRCKRSLAEIAVKAVLAVADLERKDVNLDLIKVEGKVGGKLEDTELIYGIVVDKDMSHPQMPKQIEDANIAILTCPFEPPKPKTKHKVDIDTVEKFQTLRVQEQKYFDEMVQKCKDVGATLVICQWGFDDEANHLLMHRNLPAVRWVGGVELELIAIATGGRIVPRFQELTTEKLGKAGIVREKSFGTTKDRMLYIEHCANSRAVTIFIRGGNKMIIEETKRSLHDALCVARNLIRNNSIVYGGGSAEISCSIAVDAAADRYPGVEQYAIRAFGDALEAIPMALAENSGLQPIETLSAVKSQQIKDNNPHFGIDCNDVGTNDMREQNVFETLIGKQQQILLATQVVKMILKIDDVISPSDY

SEQ ID NO: 3932 - protein, 535 aa, Fagus grandifolia
MALAFDEFGRPFIIIKEQEQKTRLRGIEAQKANISAAKAISRILRTSLGPKGMDKMLQSPDGDVTISNDGATILEQMDVDNQIAKLMVDLSRSQDYEIGDGTTGVVVLAGALLEMAEQLLERGIHPIRIAEGYEMASKIAFDHLEKISQKFEFGVPDFEPLVQTCMTTLSSKIVNRCKRSLAEIAVKAVLAVADLERKDVNLDLIKVEGKVGGKLEDTELIYGIVVDKDMSHPQMPKQIEDAKIAILTCAFEPPKPKTKHKVDIDTVEKFQTLRLQEKKYFDDMVQKCKDVGATLVICQWGFDDEANHLLMHRNLPAVRWVGGVELELIAIATGGRIVPRFQELTTEKLGKAGLVREKSFGTTKDRMLYIEHCANSRAVTIFIRGGNKMMIEETKRSIHDALCVARNLIRNNSIVYGGGSAEIACSVAVEAAADVQPGVEQYAIRAFADALDAVPMALAENSGLQPIETLSAVKAQQIKENNPYYGIDCNDVGTNDMCEQNVFETLIGKQQQILLATQVVKMILKIDDVISPAEY

SEQ ID NO: 3933 - protein, 535 aa, Chelidonium majus
MALAFDDYGRPFIIIREQEQKSRLRGLDAQKANISAGRGIARILRTSLGPKGMDKMLQSPDGDVTITNDGATILELMDVDNQIAKLMVELSRSQDYEIGDGTTGVVVLAGALLEQAERLLERGIHPIRVAEGYEMASRIAVEHLESISHKFDFSASNMEPLVRTCMTTLSSKIVNRCKRTLAEIAVKAVLAVADLERKDVNLDLIKIEGKVGGKLEDTELIYGIIVDKDMSHPQMPKRIEDANIAILTCPFEPPKPKTKHKVDIDTVEKFQTLRHQEQKYFDDMVQKCKDVGATLVICQWGFDDEANHLLMHRNLPAVRWVGGVELELIAIATGGRIVPRFQELTPEKLGKAGLVREKSFGTTKDRMLYIEKCANSRAVTIFIRGGNKMMVEETKRSIHDALCVARNLIRNKSIVYGGGSAEISCSIAVEAASDRYPGVEQYAIRGFADALDSIPMALAENSGLQPIETLSAVKSQQIKENNPCCGIDCNDVGTNDMREQNVFETLIGKQQQLMLATQVVKMILKIDDVISPSNY

SEQ ID NO: 3934 - protein, 535 aa, Gossypium hirsutum
MALAFDEYGRPFIILKEQEQKTRLSGLEAQKANISAGRAVSRILRTSLGPKGMDKMLQSPDGDVTITNDGATILEQMDVDNQIAKLMVELSRSQDYEIGDGTTGVVVMAGALLEQAERLLERGIHPIRIAEGYEMASRIAVEHLECIAQKFDFGPTNIEPLVQTCMTTLSSKIVSRCKRALAEISVKAVLSVADLERKDVNLDLIKVEGKVGGKLEDTELIYGITVDKDMSHPQMPKQIEDAKIAILTCPFEPPKPKTKHKVDIDTVEKFQTLRQQEQKYFDDMVQKCKEVGATLVICQWGFDDEANHLLMHQNLPAVRWVGGVELELIAIATGGRIVPRFQELTPEKLGRAGLVRERSFGTTKDKMLYIEHCANSRAVTIFIRGGNKMMIEETKRSIHDALCVARNLIRNNFIVYGGGAAEISCSIAVEAAADKYPGVEQYAIRAFADALDAVPMALAENSGLQPIETLSAVKSQQIKENNPHFGIDCNDVGTNDMCEQNVFETLIGKQQQILLATQVVKMILKIDDVISPSDY

SEQ ID NO: 3935 - protein, 535 aa, Lactuca sativa
MALAFDEYGRPFIILREQESKSRLRGLDAQKANISAGTAVARILRTSLGPKGMDKMLQSPDGDITITNDGATILEQMDVDNQIGKLMVELSRSQDYEIGDGTTGVVVMAGALLEQAERLLERGIHPIRVAEGYEIASKIAVDHLQQISHKFEFNPTNIEPLVQTCMTTLSSKIVNRCKRSLAEIAVKAVMAVADLERKDVNLDLIKIEGKVGGKLEDTELIYGILVDKDMSHPQMPKHIEDAKIAILTCPFEPPKPKTKHKVDIDTVEKFQTLREQERKYFDDMVQQCKDVGATLVICQWGFDDEANHLLMHRNLPAVRWVGGVELELIAIATGGRIVPRFQELTAEKLGKAGLVREKSFGTTKDRMLYIEHCANSRAVTIFIRGGNKMMIEETKRSIHDALCVARNLIRNNSIVYGGGAPEISCSIAVEAAADKYPGVEQYAVRAFADALDSVPMALAENSGLQPIETLSAVKSQQIKEKNACCGIDCNDAGTNDMREQNVFETLIGKQQQLLLATQVVKMILKIDDVISPSEY

SEQ ID NO: 3936 - protein, 535 aa, Papaver somniferum
MALAFDDYGRPFIILREQEQKSRLKGLDAQKSNIAAGKAIARILRTSLGPKGMDKIMQSPDGDITITNDGATILQMMDVDNQIAKLMVELSQSQDYEIGDGTTGVVVMAGALLEQAEKLLERGIHPVRVAEGYEMASKVAVEHLEHISHKFTFGANNIEPLVQTCMTTLSSKIVNRCKRSLAEIAVKAVLAVADLERKDVNLDLIKIEGKVGGKLEDTELIYGIIVDKDMSHPQMPKQIQDAHIAILTCPFEPPKPKTKHKVDIDTVEKFETLRLQEKKYFDDMVQKCKDVGATLVICQWGFDDEANHLLMNRNLPAVRWVGGVELELIAIATGGRIVPRFQELTIGKLGKAGLVREKSFGTTKDRMLYIEQCANSRAVTIFIRGGNKMMIEETKRSIHDALCVARNLIRNNSIVYGGGSAEISCSVAVEAAADKYPGVEQYAIRAFADALDAVPMALAENSGLQPIETLTAVKSQQIKENNPCCGIDCNDVGTNDMREQNVFETLIGKQQQLLLATQVVKMILKIDDVISPSEY

SEQ ID NO: 3937 - protein, 535 aa, Tripterygium wilfordii
MALAFDEFGRQFIILREQEQKTRLRGLDAHKSNISAGKAVARILRTSLGPKGMDKMLQSPDGDVTITNDGATILEQMDVDNQIAKLMVELSRSQDYEIGDGTTGVVVLAGALLEQAERLLERGIHPIRIAEGYEMASRIAFEHLEHIAENFEFDSSNLEPLIQTCMTTLSSKIVNRSKRSLAEIAVKAVIAVADLERKDVNFDLIKVEGKVGGKLEDTELIYGILVDKDMSHPQMPKQIEDAKIAILTCPFEPPKPKTKHKVDIDTVEKFQILRQQEQKYFDDMVQKCKDVGATLVICQWGFDDEANHLLMHRNLPAVRWVGGVELELIAIATGGRIVPRFQELTPEKLGKAGLIREKAFGTTKDRMLYIEHCANSRAVTIFIRGGNKMMIEETKRSIHDALCVARNLIRNNSIVYGGGSAEIACSIAVEAASDKHPGVEQYAIRAFADALDSVPMALAENSGLQPIETLSAVKSQQIKENSPYCGIDCNDVGTNDMRQQNVFETLIGKQQQILLATQVVKMILKIDDVISPSDF

SEQ ID NO: 3938 - protein, 535 aa, Cicer arietinum
MALAFDDYGRPYIILKEQESKNRLRGLDAQKANISAGKSVARILRTSLGPKGMDKMLQSPDGDVIISNDGATILEQMDVDNQIAKLMVELSRSQDYEIGDGTTGVVVLAGSLLEQAERLLERGIHPIRIAEGYEMASRIAVENLERIANKFEFGETILEPLIQTCMTTLSSKIVNRCKRSLAEIAVKAVLAVADLERKDVNLDLIKVEGKVGGKLEDTELIYGIVVDKDMSHPQMPKQIEDAKIAILTCPFEPPKPKTKHKVDIDTVEKFQTLRKQEQKYFDDMVQQCKDVGATLVICQWGFDDEANHLLMHRNLPAVRWVGGVELELIAIATGGRIVPRFQELTPEKLGKAGIVREKAFGTTKDRMLYIEHCANSRAVTIFIRGGNKMIIEETKRSIHDALCVARNLIRNNSIVYGGGSAEISCSIAVEAAADRYPGVEQYAIRAFGDALESIPMALAENSGLQPIETLSAVKSQQIKDNNPHFGIDCNDVGTNDMREQNVFETLIGKQQQILLATQVVKMILKIDDVISPSEY

SEQ ID NO: 3939 - protein, 535 aa, Abies balsamea
MALAFDEFGRPFIIIREQEQKTRIRGLDAQKANISAARAVARILRTSLGPKGMDKMLQSPDGDVTITNDGATILEQMDVENQIGKLMVELSRSQDYEIGDGTTGVVVTAGALLEHAEQLLERGIHPIRIAEGYEMASKMAVEHLDHISQKFEFSLNNMESLVQTCMTTLSSKIVNRCKRMLAEIAVKAVLAVADLERKDVNLDLIKVEGKVGGKLEDTELVYGIIVDKDMSHPQMPKRIEDVNIAILTCPFEPPKPKTKHKVDIDSVEKFEALREQERQYFDEMVQKCKDVGATLVICQWGFDDEANHLLMHRGLPAVRWVGGVELELIAIATGGRIVPRFQELTPEKLGKAGLVREKSFGTTKDRMLYIEKCANSRAVTIFIRGGNKMMIEETKRSLHDALCVARNLIRDNSIVYGGGSAEISCSLAIEAAADKIPGVEQYAVRAFADALDAVPMALAENSGLQPIDTLTAVKAQQIKEHNPHLGIDCNDVGTNDMKEQNVFETLMGKKQQLLLATQVVKMILKIDDVITPSGY

SEQ ID NO: 3940 - protein, 535 aa, Vitis vinifera
MALAFDEFGRPFIILRGQEQKSRLRGLDAQKANISAGKAVARILRTSLGPKGMDKILQSPDGDVTITNDGATILEQMDVDNQIAKLMVELSRSQDYEIGDGTTGVVVLAGALLEQAEGLLERGIHPIRVAEGYEMACRIAVEHLEHIAQKFEFGVTNIEPLVQTCMTTLSSKIVNRCKRSLAEIAVKAVMAVADLERRDVNLDLIKVEGKVGGKLEDTELIHGIVVDKDMSHPQMPKHIEDAKIAILTCPFEPPKPKTKHKVDIDTVEKFQTLRLQEQKYFDDMVQKCKDVGATLVICQWGFDDEANHLLMHRNLPAVRWVGGVELELIAIATGGRIVPRFQELTPEKLGKAGLVREKSFGTTKDRMLYIERCANSRAVTIFVRGGNKMIIEETKRSIHDALCVARNIIRNNSIVYGGGSAEISCSIAVEAAADKYPGVEQYAIRAFGDALDSIPMALAENSGLQPIETLSAVKSQQIKDNNAYCGIDCNDVGTYDMREQNVFETLIGKQQQILLATQVVKMILKIDDVISPTDY

SEQ ID NO: 3941 - protein, 535 aa, Pinus taeda
MALAFDEYGRPFIIIKEQEQKTRIRGLDAQKANIAAARSVARILRTSLGPKGMDKMLQSPDGDVTITNDGATILEQMDVENQIGKLMVELSRSQDYEIGDGTTGVVVTAGALLEHAEQLLERGIHPIRIAEGYEMASKLAVEHLDRISQKFEFSLNNIESLVQTCMTTLSSKIVNRCKRMLAEIAVKAVLAVADLERKDVNLDLIKVEGKVGGKLEDTELVYGIIVDKDMSHPQMPKRIEDVNIAILTCPFEPPKPKTKHKVDIDTVEKFEALRVQERQYFDEMVKRCKDVGATLVICQWGFDDEANHLLMHRGLPAVRWVGGVELELIAIATGGRIVPRFQELTPEKLGKAGLVREKSFGTTKDRMLYIEQCANSRAVTVFIRGGNKMMIEETKRSLHDALCVARNLIRDNSIVYGGGSAEISCSLAVEAAADKIPGVEQYAVRAFADALDAVPMALAENSGLQPIDTLTAVKAQQIRESNPHLGIDCNDVGTNDMKEQNVFETLIGKKQQLLLATQVVKMILKIDDVITPSGY

SEQ ID NO: 3942 - protein, 535 aa, Pseudotsuga menziesii
MALAFDEFGRPFIIIREQEQKTRIRGLDAQKANISAARAVARILRTSLGPKGMDKMLQSPDGDVTITNDGATILEQMDVENQIGKLMVELSRSQDYEIGDGTTGVVVTAGALLEHAEQLLERGIHPIRIAEGYEMASKLAVEHLDHISQKFEFSLNNIESLVQTCMTTLSSKIVNRCKRMLAEIAVKAVLAVADLERKDVNLDLIKVEGKVGGKLEDTELVYGIIVDKDMSHPQMPKRIEDVNIAILTCPFEPPKPKTKHKVDIDSVEKFEALRQQERHYFDEMVKKCKDVGATLVICQWGFDDEANHLLMHRGLPAVRWVGGVELELIAIATGGRIVPRFQELTPEKLGKAGLVREKAFGTTKDRMLYIEQCANSRAVTIFIRGGNKMMIEETKRSLHDALCVARNLIRDNSIVYGGGSAEISCSVAVEAAADKIPGVEQYAVRAFADALDAVPMALAENSGLQPIDTLTAVKAQQIKENNPHLGIDCNDVGTNDMKDQNVFETLMGKKQQFLLATQVVKMILKIDDVITPSRF

SEQ ID NO: 3943 - protein, 535 aa, Carthamus tinctorius
  misc_feature (332)..(333): Xaa can be any naturally occurring amino acid
MALAFDEYGRPFIILREQESKSRLRGLDAQKANISAGVAVARILRTSLGPKGMDKMLQSPDGDITITNDGATILEQMDVDNQIGKLMVELSRSQDYEIGDGTTGVVVMAGALLEQAERLLERGIHPIRVAEGYEIASKIAVDHLQQIAHKFEFTATHIEPLVQTCMTTLSSKIVNRCKRSLAEIAVKAVMAVADLERKDVNLDLIKVEGKVGGKLEDTELIYGILVDKDMSHPQMPKQIEDTKIAILTCPFEPPKPKTKHKVDIDTVEKFQTLRQQEQKYFDDMVQQCKDVGATLVICQWGFDDEANHLLMHRNLPAVRWVGGVELELIAIXXGGRIVPRFQELTPEKLGKAGLVREKAFGTTKDRMLYIEHCANSRAVTIFIRGGNKMMIEETKRSLHDALCVARNLIRNNNIVYGGGAAEISCSIAVEAAADKYPGVEQYAVRAFADALDSVPMALAENSGLQPIETLSAVKSQQIRDNNPFCGIDCNDAGTNDMREQNVFETLIGKQQQLLLATQVVKMILKIDDVISPAEY

SEQ ID NO: 3944 - protein, 535 aa, Helianthus annuus
MALAFDEYGRPFIILREQESKSRLRGIDAQKANISAGVAVSRILRTSLGPKGMDKMLQSPDGDITITNDGATILEQMDVDNQIGKLMVELSRSQDYEIGDGTTGVVVLAGALLEQAEKLLERGIHPIRVAEGFEISSKMAVDHLEKISHKFDFSATNIEPLVQTCMTTLSSKIVNRCKRSLAEIAVKGVMAVADLERKDVNLDLIKVEGKVGGKLEDTELVYGIIVDKDMSHPQMPKQIEDAKIAILTCPFEPPKPKTKHKVDIDTVEKFQTLRKQEQQYFDDMVQQCKDVGATLVICQWGFDDEANHLLMHRNLPAVRWVGGVELELIAIATGGRIVPRFQELTTEKLGKAGLVREKAFGTTKDRMLYIEHCANSKAVTVFIRGGNKMMIEETKRSIHDALCVARNLIRNNSIVYGGGAAEISCSIAVEAAADKYPGVEQYAIRAFADALDSVPMALAENSGLQPIETVSAVKAQQIKENNHCCGIDCNDTGTNDMREQNVFETLIGKQQQILLATQVVKMILKIDDVISPTEY

SEQ ID NO: 3945 - protein, 535 aa, Vinca minor
MALAFDEFGRPFIIIKEQESKSRLRGLDAHKSNISAGKAIARILRTSLGPKGMDKMLQSPDGDVTITNDGATILEQMDVDNQIAKLMVELSRSQDYEIGDGTTGVVVMAGALLEQAERLLERGIHPIRIAEGYEVASRIAFEHLERIRHKYEFDATDIEPLVQTCMTTLSSKIVNRCKRSLAEIAVKAVLAVADLERKDVNLDLIKVDGKVGGKLEDTELIYGIVVDKDMSHPQMPKEIRDAKIAILTCPFEPPKPKTKHKVDIDTVEKFQTLRQQEQKYFDDMVQQCKDVGASLVICQWGFDDEANHLLLHRNLPAVRWVGGVELELIAIATGGRIVPRFQELTAEKLGKAGLVREKAFGTTKDRMIYIEHCANSRAVTIFIRGGNKMMIEETKRSIHDALCVARNLIRNNSIVYGGGSAEISCSVAVDAAADKHPGVEQYAIRAFADALDAIPMALAENSGLQPIETLSAVKSQQIKENNPCCGIDCNDVGTNDMREQNVFETLIGKQQQILLATQVVKMILKIDDVITPSDF

SEQ ID NO: 3946 - protein, 541 aa, Solanum phureja
MALAFDEFGRPFIIIKEQEQKTRLRGLDAQKANISSGKAVARILRTSLGPKGMDKMLQSPEGDVTITNDGATILEQMDVDNQIAKLMVELSRSQDYEIGDGTTGVVVMAGALLEQAEKLLERGIHPIRVAEGYEMASRIAVEHLERIANKFEFGVNEFEPLIQTCMTTLSSKIVNRCKRSMAEIAVKAVLAVADLERKDVNLDLIKVEGKVGGKLEDTELIYGIVVDKDMSHPQMPKQIQDANIAILTCPFEPPKPKTKHKVDIDTVEKFQTLRLQEQKYFDDMVQKCKDVGATLVICQWGFDDEANHLLMHRNLPAVRWVGGVELELIAIATGGRIVPRFQELTPEKLGRAGLVREKSFGTTKDRMIYIEHCANSRAVTIFIRGGNKMMIEETKRSIHDALCVARNLIRNNSIVYGGGSAEISCSIAVEAAADKHPGLSIKTFYLQYAIRAFADALDSIPMALAENSGLQPIETLSAVKSQQIKENNPWCGIDCNDVGTNDMREQNVFETLIGKQQQILLATQVVKMILKIDDVISPSEY

SEQ ID NO: 3947 - protein, 535 aa, Pinus pinaster
MALAFDEYGRPFIIIKEQEQKTRIRGLDAQKANIAAARSVARILRTSLGPKGMDKMLQSPDGDVTITNDGATILEQMDVENQIGKLMVELSRSQDYEIGDGTTGVVVTAGALLEHAEQLLERGIHPIRIAEGYEMASKLAVEHLDRISQKFEFSLNNIESLVQTCMTTLSSKIVNRCKRMLAEIAVKAVLAVADLERKDVNLDLIKVEGKVGGKLEDTELVYGIIVDKDMSHPQMPKRIEDVNIAILTCPFEPPKPKTKHKVDIDTVEKFEALRVQERQYFDEMVKRCKDVGATLVICQWGFDDEANHLLMHRGLPAVRWVGGVELELIAIATGGRIVPRFQELTPEKLGKAGLVREKAFGTTKDRMLYIEQCANSRAVTVFIRGGNKMMIEETKRSLHDALCVARNLIRDNSIVYGGGSAEISCSLAVEAAADKIPGVEQYAVRAFADALDAVPMALAENSGLQPIDTLTAVKAQQIRENNPHLGIDCNDVGTNDMKEQNVFETLIGKKQQFLLATQVVKMILKIDDVITPSGV

SEQ ID NO: 3948 - protein, 535 aa, Papaver somniferum
MALAFDDYGRPFIILREQEQKSRLKGLDAQKSNIAAGKAIARILRTSLGPKGMDKIMQSPDGDITITNDGATILQMMDVDNQIAKLMVELSQSQDYEIGDGTTGVVVMAGALLEQAEKLLERGIHPVRVAEGYEMASKVAVEHLEHISHKFTFGANNIEPLVQTCMTTLSSKIVNRCKGSLAEIAVKAVLAVADLERKDVNLDLIKIEGKVGGMLEDTELIYGIIVDKDMSHPQMPKQIQDAHIAILTCPFEPPKPKTKHKVDIDTVEKFETLRLQEKKYFDDMVQKCKDVGATLVICQWGFDDEANHLLMNRNLPAVRWVGGVELELIAIATGGRIVPRFQELTTEKLGKAGLVREKSFGTTKDRMLYIEQCANSRAVTIFIRGGNKMMIEETKRSIHDALCVARNLIRNNSIVYGGGSAEISCSVAVEAAADKYPGVEQYAIRAFADALDAVPMALAENSGLQPIETLTSVKSQQIKENNPCCGIDCNDVGTNDMREQNVFETLIGKQQQLLLATQVVKMILKIDDVISPSEY

SEQ ID NO: 3949 - protein, 535 aa, Raphanus sativus
MALAFDEFGRPFIILREQDQKTRLRGIDAQKANIAAGKAVARILRSSLGPKGMDKMLQGPDGDVTITNDGATILEQMDVDNQIAKLMVELSRSQDYEIGDGTTGVVVMAGALLEQAERQLDRGIHPIRVAEGYEMASRVAVEHLERISQKFEFDNDNYEPLVQTCMTTLSSKIVNRCKRSLAEIAVKAVLAVADLERKDVNLDLIKIEGKVGGNLEDTELIYGILVDKDMSHPQMPKQIEDAHIAILTCPFEPPKPKTKHKVDIDTVEKFETLRKQEQQYFDEMVQKCKDVGATLVICQWGFDDEANHLLMHRNLPAVRWVGGVELELIAIATGGRIVPRFQELTAEKLGKAGMVREKSFGTTKERMLYIEHCANSKAVTIFIRGGNKMMIEETKRSIHDALCVARNLIRNKSIVYGGGAAEIACSLAVDAAADKYPGVEQYAIRAFAEALDSVPMALAENSGLQPIETLSAVKSQQLKENIPFYGIDCNDVGTNDMREQNVFETLIGKQQQILLATQVVKMILKIDDVISNSEY

SEQ ID NO: 3950 - protein, 535 aa, Valeriana officinalis
MALAFDEFGRPFIIIKEQEQKSRLRGLDAQKSNISAGKAVARILRTSLGPKGMDKMLQSPDGDITITNDGATILEQMDCDNQIGKLMVELSRSQDYEIGDGTTGVVVLAGGLLEQAERLLERGIHPIRVAEGFEMASRIAVEHLESISHKFDFSQTNIEPLVQTCMTTLSSKIVNRCKRSLAEIAVKAVMSVADLERKDVNLDLIKVEGKVGGKLEDTELIHGILVDKDMSHPQMPKQIQDAKIAILTCPFEPPKPKTKHKVDIDTVEKFQTLRVQEQKYFDDMVQKCKDVGATLVICQWGFDDEANHLLMHRNLPAVRWVGGVELELIAIATGGRIVPRFQELTTEKLGKAGLVREKAFGTTKDRMLYIEHCANSRAVTIFIRGGNKMIIEETKRSIHDALCVARNLIRNNSIVYGGGAAEISCSIAVETAADKFPGVEQYAIRAFADALDSVPMALAENSGLQPIETLSAVKSQQIKDNNPCCGIDCNDTGTNDMREQNVFETLIGKQQQILLATQVVKMILKIDDVISPSEF

SEQ ID NO: 3951 - protein, 539 aa, Cirsium arvense
YKQQVALAFDEYGRPFIILREQESKSRLRGLDAQKANISAGVAVARILRTSLGPKGMDKMLQSPDGDITITNDGATILEQMDVDNQIGKLMVELSRSQDYEIGDGTTGVVVMAGALLEQAERLLERGIHPIRVAEGYEIASKIAVDHLQQISHKFEFSATHIEPLVQTCMTTLSSKIVNRCKRSLAEIAVKAVMAVADLERKDVNLDLIKVEGKVGGKLEDTELIYGILVDKDMSHPQMPKQIEDAKIAILTCPFEPPKPKTKHKVDIDTVEKFQTLRVQEKKYFDDMVQQCKDVGATLVICQWGFDDEANHLLMHRNLPAVRWVGGVELELIAIATGGRIVPRFQELTPEKLGKAGLVREKAFGTTKDRMLYIEHCANSRAVTVFIRGGNKMMIEETKRSIHDALCVARNLIRNNSIVYGGGSAEISCSIAVEAAADKYPGVEQYAVRAFADALDSVPMALAENSGLQPIETLSAVKSQQIKDNNPCCGIDCNDAGTNDMREQNVFETLIGKQQQLLLATQVVKMILKIDDVISPTEY

SEQ ID NO: 3952 - protein, 535 aa, Brassica rapa
MALAFDEFGRPFIILREQDQKTRLRGIDAQKANIAAGKAVARILRSSLGPKGMDKMLQGPDGDVTITNDGATILEQMDVDNQIAKLMVELSRSQDYEIGDGTTGVVVMAGALLEQAERQLDRGIHPIRVAEGYEMASRVAVEHLERISQKFEFDVDNFEPLVKTCMTTLSSKIVNRCKRSLAEIAVKAVLAVADLERRDVNLDLIKVEGKVGGNLEDTELIYGILVDKDMSHPQMPKQIEDAHIAILTCPFEPPKPKTKHKVDIDTVEKFETLRKQEQQYFDEMVQKCKDVGATLVICQWGFDDEANHLLMHRNLPAVRWVGGVELELIAIATGGRIVPRFQELTTEKLGKAGMVREKSFGTTKERMLYIEHCANSKAVTIFIRGGNKMMIEETKRSIHDALCVARNLIRNKSIVYGGGAAEIACSLAVDAAADKYPGVEQYAIRAFAEALDSVPMALAENSGLQPIETLSAVKSQQLKENIPFYGIDCNDVGTNDMREQNVFETLIGKQQQILLATQVVKMILKIDDVISNSEY

SEQ ID NO: 3953 - protein, 535 aa, Brassica napus
MALAFDEFGRPFIILREQDQKTRLRGIDAQKANIAAGKAVARILRSSLGPKGMDKMLQGPDGDVTITNDGATILEQMDVDNQIAKLMVELSRSQDYEIGDGTTGVVVMAGALLEQAERQLDRGIHPIRIAEGYEMASRVAVEHLERISQKFEFDVNNYEPLVQTCMTTLSSKIVNRCKRSLAEIAVKAVLAVADLERRDVNLDLIKVEGKVGGNLEDTELIYGILVDKDMSHPQMPKQIEDAHIAILTCPFEPPKPKTKHKVDIDTVEKFETLRKQEQQYFDEMVQKCKDVGATLVICQWGFDDEANHLLMHRNLPAVRWVGGVELELIAIATGGRIVPRFQELTPEKLGKAGMVREKSFGTTKERMLYIEHCANSKAVTIFIRGGNKMMIEETKRSIHDALCVARNLIRNKSIVYGGGAAEIACSLAVDAAADKYPGVEQYAIRAFAEALDSVPMALAENSGLQPIETLSAVKSQQLKENIPFYGIDCNDVGTNDMREQNVFETLIGKQQQILLATQVVKMILKIDDVISNSEY

SEQ ID NO: 3954 - protein, 535 aa, Brassica napus
MALAFDEFGRPFIILREQDQKTRLRGIDAQKANIAAGKAVARILRSSLGPKGMDKMLQGPDGDVTISNDGATILEQMDVDNQIAKLMVELSRSQDYEIGDGTTGVVVMAGALLEQAERQLDRGIHPIRIAEGYEMASRVAVEHLERIAQKFEFDVNNYEPLVQTCMTTLSSKIVNRCKRSLAEIAVKAVLAVADLERRDVNLDLIKVEGKVGGKLEDTELIYGILVDKDMSHPQMPKHIEDAHIAILTCPFEPPKPKTKHKVDIDTVEKFETLRKQEQQYFDEMVQKCKDVGATLVICQWGFDDEANHLLMHRNLPAVRWVGGVELELIAIATGGRIVPRFQELTPEKLGKAGMVREKSFGTTKERMLYIEHCANSKAVTIFIRGGNKMMIEETKRSIHDALCVARNLIRNNSIVYGGGAAEITCSLAVDAAADKYPGVEQYAIRAFAEALDSVPMALAENSGLQPIETLSAVKSQQIKENIPFYGIDCNDVGTNDMREQNVFETLIGKQQQILLATQVVKMILKIDDVISNSEY

SEQ ID NO: 3955 - protein, 535 aa, Brassica napus
MALAFDEFGRPFIILREQDQKTRLRGIDAQKANIAAGKAVARILRSSLGPKGMDKMLQGPDGDVTITNDGATILEQMDVDNQIAKLMVELSRSQDYEIGDGTTGVVVMAGALLEQAERQLDRGIHPIRVAEGYEMASRVAVEHLERISQKFEFDVNNFEPLVQTCMTTLSSKIVNRCKRSLAEIAVKAVLAVADLERRDVNLDLIKIEGKVGGNLEDTELIYGILVDKDMSHPQMPKQIEDAHIAILTCPFEPPKPKTKHKVDIDTVEKFETLRKQEQQYFDEMVQKCKDVGATLVICQWGFDDEANHLLMHRNLPAVRWVGGVELELIAIATGGRIVPRFQELTPEKLGKAGMVREKSFGTTKERMLYIEHCANSKAVTIFIRGGNKMMIEETKRSIHDALCVARNLIRNKSIVYGGGAAEIACSLAVDAAADKYPGVEQYAIRAFAEALDSVPMALAENSGLQPIETLSAVKSQQLKENIPFYGIDCNDVGTNDMREQNVFETLIGKQQQILLATQVVKMILKIDDVISNSEY

SEQ ID NO: 3956 - protein, 535 aa, Populus trichocarpa
MALAFDEFGRPFVIIKEQDQKVRLRGLDAQKANIASGMAVSRILRTSLGPKGMDKMLQSPDGDVTITNDGATILEQMDVDNQIAKLLVELSRSQDYEIGDGTTGVVVLAGALLEQSQKLLERGIHPIRVAEGYETASRIAVEHLEKISQKYDFGVNNMEPLVQTCMTTLSSKIVNRCKRSLAEISVKAVLAVADLERKDVNLDLIKVEGKVGGKLEDTELIYGILVDKEMSHPQMPKQIEDAKIAILTCPFEPPKPKTKHKVDIDTVEKFQTLRKQEQQYFDVMVQKCKDVGATLVICQWGFDDEANHLLMHRNLPAVRWVGGVELELIAIATGGRIVPRFQELTPEKLGKAGLVREKAFGTTKDRMLYVEHCANSRAVTIFIRGGNKMIIEETKRSIHDALCVARNLIRNNSIVYGGGSAEISCSVAVEAAADRYPGVEQYAIRAFADALDSVPMALAENSGLQPIETLSAVKSQQIKENNHYCGIDCNDAGTNDMREQNVFETLIGKQQQIFLATQVVKMILKIDDVISPSEY

SEQ ID NO: 3957 - protein, 535 aa, Eutrema halophilum
MALAFDEFGRPFIILREQDQKTRLRGIDAQKANIAAGKAVARILRSSLGPKGMDKMLQGPDGDVTITNDGATILEQMDVDNQIAKLMVELSRSQDYEIGDGTTGVVVMAGALLEQAERQLDRGIHPIRIAEGYEMASRVAVEHLERIAQKFEFDVNNFEPLVQTCMTTLSSKIVNRCKRSLAEIAVKAVLAVADLERRDVNLDLIKVEGKVGGKLEDTELIYGILVDKDMSHPQMPKQIEDAHIAILTCPFEPPKPKTKHKVDIDTVEKFETLRKQEQQYFDEMVKKCKDVGATLVICQWGFDDEANHLLMHRNLPAVRWVGGVELELIAIATGGRIVPRFQELTPEKLGKAGLVREKSFGTTKERMLYIEHCANSRAVTVFIRGGNKMMIEETKRSIHDALCVARNLIRNKSIVYGGGAAEIACSLAVDAAADKYPGVEQYAIRAFAEALDSVPMALAENSGLQPIETLSAVKSQQIKENIPFYGIDCNDVGTNDMREQNVFETLIGKQQQILLATQVVKMILKIDDVISNSEY

SEQ ID NO: 3958 - protein, 535 aa, Vinca minor
MALAFDEFGRPFIVIKEQESKTRLRGLDAHKSNISAGKAVARILRTSLGPKGMDKMLQSPDGDVTITNDGATILELMDVDNQIAKLMVELSRSQDYEIGDGTTGVVVMAGALLEQAERLLERGIHPIRIAEGYEVASRIAFEHLERITHKYEFDATDIEPLVRTCMTTLSSKIVNRCKRSLAEIAVKAVVAVADLERRDVNLDLIKVEGKVGGKLEDTELIYGIVVDKDMSHPQMPKEIQNAKIAILTCPFEPPKPKTKHKVDIDTVEKFQTLRQQEHKYFDDMVQQCKDVGASLVICQWGFDDEANHLLMHRNLPAVRWVGGVELELIAIATGGRIVPRFQELTAEKLGKAGLVREKAFGTTKDRMIYIEHCANSRAVTIFIRGGNKMMIEETKRSIHDALCVARNLIRNNSIVYGGGSAEISCSVAVEAAADKHPGVEQYAIRAFADALDAIPMALAENSGLQPIETLSAVKSQQIKENNPCCGIDCNDVGTNDMREQNVFETLIGKQQQILLATQVVKMILKIDDVITPSDF

SEQ ID NO: 3959 - protein, 535 aa, Brassica juncea
MALAFDEFGRPFIILREQDQKTRLRGIDAQKANIAAGKAVARILRSSLGPKGMDKMLQGPDGDVTITNDGATILEQMDVDNQIAKLMVELSRSQDYEIGDGTTGVVVMAGALLEQAERQLDRGIHPIRIAEGYEMASRVAVEHLERIAQKFEFDVNNYEPLVQTCMTTLSSKIVNRCKRSLAEIAVKAVLAVADLERRDVNLDLIKVEGKVGGNLEDTELIYGILVDKDMSHPQMPKQIEDAHIAILTCPFEPPKPKTKHKVDIDTVEKFETLRKQEQQYFDEMVQKCKDVGATLVICQWGFDDEANHLLMHRNLPAVRWVGGVELELIAIATGGRIVPRFQELTPEKLGKAGMVREKSFGTTKERMLYIEHCANSKAVTIFIRGGNKMMIEETKRSIHDALCVARNLIRNKSIVYGGGAAEIACSLAVDAAADKYPGVEQYAIRAFAEALDSVPMALAENSGLQPIETLSAVKSQQLKENIPFYGIDCNDVGTNDMREQNVFETLIGKQQQILLATQVVKMILKIDDVISNSEY

SEQ ID NO: 3960 - protein, 535 aa, Brassica rapa
MALAFDEFGRPFIILREQDQKTRLRGIDAQKANIAAGKAVARILRSSLGPKGMDKMLQGPDGDVTITNDGATILEQMDVDNQIAKLMVELSRSQDYEIGDGTTGVVVMAGALLEQAERQLDRGIHPIRIAEGYEMASRVAVEHLERISQKFEFDVNNYEPLVQTCMTTLSSKIVNRCKRSLAEIAVKAVLAVADLERRDVNLDLIKVEGKVGGNLEDTELIYGILVDKDMSHPQMPKQIEDAHIAILTCPFEPPKPKTKHKVDIDTVEKFETLRKQEQQYFDEMVQKCKDVGATLVICQWGFDDEANHLLMHRNLPAVRWVGGVELELIAIATGGRIVPRFQELTPEKLGKAGMVREKSFGTTKERMLYIEHCANSKAVTIFIRGGNKMMIEETKRSIHDALCVARNLIRNKSIVFGGGAAEIACSLAVDAAADKYPGVEQYAIRAFAEALDSVPMALAENSGLQPIETLSAVKSQQLKENIPFYGIDCNDVGTNDMREQNVFETLIGKQQQILLATQVVKMILKIDDVISNSEY

SEQ ID NO: 3961 - protein, 535 aa, Brassica napus
MALAFDEFGRPFIILREQDQKTRLRGIDAQKANIAAGKAVARILRSSLGPKGMDKMLQGPDGDVTISNDGATILEQMDVDNQIAKLMVELSRSQDYEIGDGTTGVVVMAGALLEQAERQLDRGIHPIRIAEGYETASRVAVEHLERIAQKFEFDVNNYEPLVQTCMTTLSSKIVNRCKRSLAEIAVKAVLAVADLERRDVNLDLIKVEGKVGGKLEDTELIYGILVDKDMSHPQMPKQIEDAHIAILTCPFEPPKPKTKHKVDIDTVEKFETLRKQEQQYFDEMVQKCKDVGATLVICQWGFDDEANHLLMHRNLPAVRWVGGVELELIAIATGGRIVPRFQELTPEKLGKAGMVREKSFGTTKERMLYIEHCANSKAVTIFIRGGNKMMIEETKRSIHDALCVARNLIRNNSIVYGGGAAEITCSLAVDAAADKYPGVEQYAIRAFAEALDSVPMALAENSGLQPIETLSAVKSQQIKENIPFYGIDCNDVGTNDMREQNVFETLIGKQQQILLATQVVKMILKIDDVISNSEY

SEQ ID NO: 3962 - protein, 535 aa, Raphanus sativus
  misc_feature (216)..(216): Xaa can be any naturally occurring amino acid
MALAFDEFGRPFIILREQDQKTRLRGIDAQKANIAAGKAVARILRSSLGPKGMDKMLQGPDGDVTISNDGATILEQMDVDNQIAKLMVELSRSQDYEIGDGTTGVVVMAGALLEQAERQLDRGIHPIRIAEGYEMASRVAVEHLERIAQKFEFDVDNYEPLVQTCMTTLSSKIVNRCKRSLAEIAVKAVLAVADLERRDVNLDLIKVEGKVGGNLXDTELIYGILVDKDMSHPQMPKQIEDAHIAILTCPFEPPKPKTKHKVDIDTVEKFETLRKQEQQYFDEMVQKCKDVGATLVICQWGFDDEANHLLMHRNLPAVRWVGGVELELIAIATGGRIVPRFQELTPEKLGKAGMVREKSFGTTKERMLYIEHCANSKAVTIFIRGGNKMMIEETKRSIHDALCVARNLIRNNSIVYGGGAAEITCSLAVDAAADKYPGVEQYAIRAFAEALDSVPMALAENSGLQPIETLSAVKSQQIKENIPFYGIDCNDVGTNDMREQNVFETLIGKQQQILLATQVVKMILKIDDVISNSEY

SEQ ID NO: 3963 - protein, 524 aa, Tabernaemontana elegans
FIIIKEQEQKTRLRGVDAQKANISAGKAVARILRTSLGPKGMDKMLQSPDGDVTITNDGATILEQMDVDNQIAKLMVELSRSQDYEIGDGTTGVVVMAGALLEQAERLLERGIHPIRIAEGYEVASRIAFEHLERIAHKFEFDATNVEPLIQTCMTTLSSKIVNRCKRSLAEIAVKAVLAVADLERKDVNLDLIKVEGKVGGKLEDTELIYGIVVDKDMSHPQMPKEIQDAKIAILTCPFEPPKPKTKHKVDIDTVEKFQTLRQQEQKYFDDMVQKCKDVGATLVICQWGFDDEANHLLMHRNLPAVRWVGGVELELIAIATGGRIVPRFQELTPEKLGKAGLVREKSFGTTKDRMIYIEHCANSRAVTIFIRGGNKMIIEETKRSLHDALCVARNLIRNNSIVYGGGSAEISCSVAVEAAADKYPGVEQYAIRAFADALDSIPMALAENSGLQPIETLSAVKSQQIKENNPCCGIDCNDVGTNNMREQNVFETLIGKQQQILLATQVVKMILKIDDVISPSEY

SEQ ID NO: 3964 - protein, 535 aa, Tripterygium wilfordii
MALAFDEFGRPFIIIKDQEQKTRLRGLDAQKANISAGKAVARILRTSLGPKGMDKMLQSPDGDVTISNDGATILEQMDVDNQIAKLMVELSRSQDYEIGDGTTGVVVLAGGLLEQAERLLERGIHPIRIAEGYEMASRIAFEHLEHISEKFEFESSNLEPLIQTCMTTLSSKMVNRNKRSLAEIAVNAVVAVADLERRDVNLDLIKVEGKVGGKLEDTELIYGIVVDKDMSHPQMPKQIEDAKIAILTCPFEPPKPKTKHKVDIDTVEKFQTLRQQEHKYFDDMVQKCKDVGATLVICQWGFDDEANHLLMHRNLPAVRWVGGVELELIAIATGGRIVPRFQELTTEKLGKAGVVREKSFGTTKDRMLYIEHCANSRAVTIFIRGGNKMMIEETKRSIHDALCVARNLIRNKSIVYGGGSAEIACSIAVEAASDRHPGVEQYAIRAFADALDSVPMALAENSGLQPIETLSAVKSQQIKENNPYYGIDCNDVGTNDMRQQNVFETLIGKQQQILLATQVVKMILKIDDVISPSDF

SEQ ID NO: 3965 - protein, 388 aa, Ambrosia trifida
MALAFDEYGRPFIILREQESKTRLRGIDAQKANISAGVAVSRILRTSLGPKGMDKMLQSPDGDITITNDGATILEQMEVDNQIGKLMVELSRSQDYEIGDGTTGVVVLAGALLEQAEKLLERGIHPIRVAEGFEISSKMAVDHLEKISHKFDFSASNIEPLVQTCMTTLSSKIVNRCKRSLAEIAVKGVMAVADLERKDVNLDLIKVEGKVGGKLEDTELIYGIIVDKDMSHPQMPKQIEDAKIAILTCPFEPPKPKTKHKVDIDTVEKFQTLRKQEQQYFDDMVQKCKDVGATLVICQWGFDDEANHLLMHRNLPAVRWVGGVELELIAIATGGRIVPRFQELTTEKLGKAGLVREKAFGTTKDRMLYIEHCANSKAVTVFIVEVTR

SEQ ID NO: 3966 - protein, 535 aa, Arabidopsis lyrata
MALAFDEFGRPFIILREQDQKTRLRGIDAQKANIAAGKAVARILRSSLGPKGMDKMLQGPDGDITITNDGATILEQMDVDNQIAKLMVELSRSQDYEIGDGTTGVVVMAGALLEQAERQLDRGIHPIRIAEGYEMASRVAVDHLERIAQKFEFDVNNFEPLVQTCMTTLSSKIVNRCKRSLAEIAVKAVLAVADLERRDVNLDLIKVEGKVGGKLEDTELIYGILIDKDMSHPQMPKQIEDAHIAILTCPFEPPKPKTKHKVDIDTVEKFETLRKQEQQYFDEMVQKCKDVGATLVICQWGFDDEANHLLMHRNLPAVRWVGGVELELIAIATGGRIVPRFQELTPEKLGKAGVVREKSFGTTKERMLYIEHCANSKAVTVFIRGGNKMMIEETKRSIHDALCVARNLIRNKSIVYGGGAAEIACSLAVDAAADKYPGVEQYAIRAFAEALDSVPMALAENSGLQPIETLSAVKSQQIKENIPFYGIDCNDVGTNDMREQNVFETLIGKQQQILLATQVVKMILKIDDVISNSEY

SEQ ID NO: 3967 - protein, 535 aa, Brassica rapa
MALAFDEFGRPFIILREQDQKTRLRGIDAQKANIAAGKAVARILRSSLGPKGMDKMLQGPDGDVTISNDGATILEQMDVDNQIAKLMVELSRSQDYEIGDGTTGVVVMAGALLEQAERQLDRGMHPIRIAEGYEMASRVAVEHLERIAQKFEFDVNNYEPLVQTCMTTLSSKIVNRCKRSLAEIAVKAVLAVADIERRDVNLDLIKVEGKVGGKLEDTELIYGILVDKDMSHPQMPKQIEDAHIAILTCPFEPPKPKTKHKVDIDTVEKFETLRKQEQQYFDEMVQKCKDVGATLVICQWGFDDEANHLLMHRNLPAVRWVGGVELELIAIATGGRIVPRFQELTPEKLGKAGMVREKSFGTTKERMLYIEHCANSKAVTIFIRGGNKMMIEETKRSIHDALCVARNLIRNNSIVYGGGAAEITCSLAVDAAADKYPGVEQYAIRAFAEALDSVPMALAENSGLQPIETLSAVKSQQIKENIPFYGIDCNDVGTNDMREQNVFETLIGKQQQILLATQVVKMILKIDDVISNSEY

SEQ ID NO: 3968 - protein, 325 aa, Brassica napus
MALAFDEFGRPFIILREQDQKTRLRGIDAQKANIAAGKAVARILRSSLGPKGMDKMLQGPDGDVTITNDGATILEQMDVDNQIAKLMVELSRSQDYEIGDGTTGVVVMAGALLEQAERQLDRGIHPIRIAEGYEMASRVAVEHLERISQKFEFDVNNYEPLVQTCMTTLSSKIVNRCKRRLAEIAVKAVLAVADLERRDVNLDLIKVEGKVGGNLEDTELIYGILVDKDMSHPQMPKQIEDAHIAILTCPFEPPKPKTKHKVDIDTVQKFETLRKQEQQYFDEMVQKCKDVGATLVICQWGFDDEANHLLMHRNLPAVRWVGVLN

SEQ ID NO: 3969 - protein, 326 aa, Centaurea maculosa
  misc_feature (34)..(34): Xaa can be any naturally occurring amino acid
  misc_feature (52)..(53): Xaa can be any naturally occurring amino acid
  misc_feature (226)..(226): Xaa can be any naturally occurring amino acid
  misc_feature (303)..(303): Xaa can be any naturally occurring amino acid
MDKMLQSPDADITITNDGATILEQMDVDNQIGKXMVELSQSQDYEIGDGTTXXVVMAGALLEQAERLLERGIHPIRVAEGFEISSRIAVDHLEQISHKFEFTATNIEPLVQTCMTTLSSKIVNRCKRSLAEIAVKGVMAVADLERKDVNLDLIKVEGKVGGKLEDTELIYGIIVDKDMSHPQMPKQIEDAKIAILTCPFEPPKPKTKHKVDIDTVEKFQTLREQEXKYFDEMVQRCKDVGATLVICQWGFDDEANHLLMHRNLPAVRWVGGVELELIAIATGGRIVPRFQELTPEKLGKAGLXKRRHLVPQKIECFILSIVQIQEL

SEQ ID NO: 3970 - protein, 160 aa, Zostera marina
MALAFDEYGRPFIIIKEQEQKSRVRGLEAQKANINAGKTVARILRTSLGPKGMDKMLQSPDGELTITNDGATILEQMDVDNQIAKLMVELSRSQDYEIGDGTTGVVVLAGALLEQAEKLLERGIHPIRVAEGYEMASRIAVDNLEHIPKSSISVLRIWSH

SEQ ID NO: 3971 - protein, 535 aa, Arabidopsis thaliana
MALAFDEFGRPFIILREQDQKTRLRGIDAQKANIAAGKAVARILRSSLGPKGMDKMLQGPDGDITITNDGATILEQMDVDNQIAKLMVELSRSQDYEIGDGTTGVVVMAGALLEQAERQLDRGIHPIRIAEGYEMASRVAVEHLERIAQKFEFDVNNYEPLVQTCMTTLSSKIVNRCKRSLAEIAVKAVLAVADLERRDVNLDLIKVEGKVGGKLEDTELIYGILIDKDMSHPQMPKQIEDAHIAILTCPFEPPKPKTKHKVDIDTVEKFETLRKQEQQYFDEMVQKCKDVGATLVICQWGFDDEANHLLMHRNLPAVRWVGGVELELIAIATGGRIVPRFQELTPEKLGKAGVVREKSFGTTKERMLYIEHCANSKAVTVFIRGGNKMMIEETKRSIHDALCVARNLIRNKSIVYGGGAAEIACSLAVDAAADKYPGVEQYAIRAFAEALDSVPMALAENSGLQPIETLSAVKSQQIKENIPFYGIDCNDVGTNDMREQNVFETLIGKQQQILLATQVVKMILKIDDVISNSEY

SEQ ID NO: 3972 - protein, 535 aa, Populus trichocarpa
MALAFDEFGRPFVIIKEQDQKVRLRGLDAQKANIASGMAVSRILRTSLGPKGMDKMLQSPDGDVTITNDGATILEQMDVDNQIAKLLVELSRSQDYEIGDGTTGVVVLAGALLEQAQKLLERGVHPIRVAEGYETASRIAVEHLEKIAQKFDFGVNNIEPLVKTCMTTLSSKIVNRCKRSLAEISVKAVLAVADLERKDVNLDLIKVEGKVGGKLEDTELIYGILVDKEMSHPQMPKQIEDAKIAILTCPFEPPKPKTKHKVDIDTVEKFQTLRKQEQQYFDNMVQKCKGVGATLVICQWGFDDEANHLLMHRNLPAVRWVGGVELELIAIATGGRIVPRFEELTPEKLGKAGLVREKAFGTTKDRMLYVEHCANSRAVTIFIRGGNKMMIEETKRSIHDALCVARNLIRNNSIVYGGGSSEISCSISVEAAADRYPGVEQYAIRAFADALDSVPMSLAENSGLQPIETLSAVKSQQIKENNPYCGIDCNDAGTNDMREQNVFETLIGKQQQILLATQVVKMILKIDDVISPSDF

SEQ ID NO: 3973 - protein, 535 aa, Sequoia sempervirens
MALAFDEFGRPFIILREQEQKSRVKGLDAQKANIAAARAVARILRTSLGPKGMDKMLTSPDGEVTISNDGATILEQMDVENQIGKLMVELSRSQDYEIGDGTTGVVVTAGALLEQAEQLLERGIHPIRIAEGYEMASKISVDHLDRIAQKFEFSLNNVEPLVQTCMTTLSSKIVNRCKRMLAEIAVKAVLAVADLERKDVNLDLIKVEGKVGGRLEDTELVEGIVIDKDMSHPQMPKRIEDAKIAILTCPFEPPKPKTKHKVDIDTVEKFEALRGQERQYFDEMVQRCKDVGATLVICQWGFDDEANHLLMHRGLPAVRWVGGVELELIAIATGGRIVPRFQELTSDKLGKAGLVREKAFGTTKDRMLYIEHCANSKAVTVFIRGGNKMMIEETKRSLHDALCVARNLIRNNSIVYGGGSAEISCSLAVEAAADKIPGVEQYAVRAFADALDAVPMALAENSGLQPIDTLTAVKAQQIRENNPHLGIDCNDIGTNDMMEQNVFETLIGKKQQILLATQVVKMILKIDDVISPSGY

SEQ ID NO: 3974 - protein, 535 aa, Eutrema parvulum
MALAFDEFGRPFIILREQDQKTRLRGIDAQKANIAAGKAVARILRSSLGPKGMDKMLQGPDGDVTITNDGATILEQMDVDNQIAKLMVELSRSQDYEIGDGTTGVVVMAGALLEQAERQLDRGIHPIRIAEGYEMASRVAVEHLERIAQKFEFDVNNFEPLVQTCMTTLSSKIVNRCKRTLAEIAVKAVLAVADLERRDVNLDLIKVEGKVGGNLEDTELIYGILIDKDMSHPQMPKQIEDAHIAILTCPFEPPKPKTKHKVDIDTVEKFETLRKQEQQYFDEMVQKCKDVGATLVICQWGFDDEANHLLMHRNLPAVRWVGGVELELIAIATGGRIVPRFQELTPEKLGKAGVVREKSFGTTKERMLYIEHCANSKAVTVFIRGGNKMMIEETKRSIHDALCVARNLIRNKSIVYGGGAAEIACSLAVDAAADKYPGVEQYAIRAFAEALDSVPMALAENSGLQPIETLSAVKSQQLKENIPFYGIDCNDVGTNDMREQNVFETLIGKQQQILLATQVVKMILKIDDVISNSEY

SEQ ID NO: 3975 - protein, 535 aa, Cephalotaxus harringtonia
MALAFDEFGRPFIILREQEQKSRVKGLDAQKANIAAAKAVARIIRTSLGPKGMDKMLTSPDGDVTISNDGATILEQMDVENQIGKLMVELSRSQDYEIGDGTTGVVVTAGALLEQAEQLLERGIHPIRIAEGYEMASKVAVEHLGHIAQKYEFSLNNVESLVQTCMTTLSSKIVNRCKRMLAEIAVKAVLAVADLERKDVNLDLIKVEGKVGGKLEDTELVQGIVIDKDMSHPQMPKRIEDAKIAILTCPFEPPKPKTKHKVDIDTVEKFEALRGQERQYFDEMVQRCKDVGATLVICQWGFDDEANHLLMHRGLPAVRWVGGVELELIAIATGGRIVPRFQELTPDKLGKAGLVREKAFGTTKDRMLYIEHCANSKAVTVFIRGGNKMMIEETKRSLHDALCVARNLIRDNSIVYGGGSAEISCSLAVEAAADKIPGVEQYAVRAFADALDAVPMALAENSGLQPIDTLTAVKAQQIKENNPYLGIDCNDIGTNDMMEQNVFETLIGKKQQILLATQVVKMILKIDDVISPSAF

SEQ ID NO: 3976 - protein, 535 aa, Aquilegia formosa
MALAFDEYGRSFIIIREQEQKSRLRGLDAQKSNIAAGKTLARILRTSLGPKGMDKMLQSPDGDVTISNDGATILDQMDVDNHIAKLMVELSRSQDYEIGDGTTGVVVLAGALLEQAERLLERGVHPIRVGEGYEMASKIAVDHLEHIALKFEFDAANTEPLVQTCMTTLSSKIVNRCKRMLAEIAVKAVVAVADLERRDVNLDLIKVEGKVGGKLEDTELINGIILDKDMSHPQMPKQIQNAKIAILTCPFEPPKPKTKHKVDIDSVEKFQTLRLQEQKYFDDMVQKCKDAGATLVICQWGFDDEANHLLMHRNLPAVRWVGGVELELIAIATGGRIVPRFQELTTEKLGKAGLVREKSFGTTKERMLYIEECANSRAVTIFIRGGNKMIIEETKRSVHDALCVARNLIRNNSIVYGGGSAEISCSIAVEAAADKYPGVEQYAIRAFADALESVPMALAENSGLQPIETVSAVKSQQVKENNSYCGIDCNDVGTNDMRKQNVFETLIGKQQQLLLATQVVKMILKIDDIISPSEY

SEQ ID NO: 3977 - protein, 535 aa, Podocarpus macrophillus
MALAFDEYGRPFIIIKEQEQKTRVRGLDAQKANIAAAKAVARIIRTSLGPKGMDKMLKSPDGDVTISNDGATILEQMDVENQIGKLMVELSRSQDYEIGDGTTGVVVTAGALLEQAEQLLDRGIHPIRIAEGYEMASKIAVEHLGNIAQKFEFGLNNVESLVQTCMTTLSSKIVNRCKRMLAEIAVKAVLAVADLERKDVNLELIKVEGKVGGKLEDTELVYGIVIDKDMSHPQMPKRIEDAKIAILTCPFEPPKPKTKHKVDIDTVEKFEALRDQEKKYFDDMVQICKDVGATLVICQWGFDDEANHLLMHRGLPAVRWVGGVELELIAIATGGRIVPRFQELTPDKLGKAGIVREKGFGTTKDRMLYIEQCANSKAVTVFIRGGNKMMIEETKRSLHDALCVARNLIRDNSIVYGGGSAEISCSLAVEAAADKIPGVEQYAIRAFADALDAVPIALAENSGLQPIDTLTAVKAQQIKENNPHLGIDCNDVGTNDMMEQNVFETLIGKKQQILLATQVVKMILKIDDVISAAGF

SEQ ID NO: 3978 - protein, 536 aa, Sciadopitys verticillata
MALAFDEYGRPFIIIRDQENKSRVRGLDAQKTNIAAAKAVARIIRTSLGPKGMDKMLTSPDGDVTISNDGATILEQMDVENQIGKLMVELSRSQDYEIGDGTTGVVVTAGALLEQAEQLLEKGIHPIRIAEGYEMASKIAVEHLERIAQKFEFSLNNVEPLVQTCMTTLSSKIVNRCKRMLAEIAVNAVLAVADLERKDVNLDLIKVEGKVGGRLEDTELVAGIVVDKDMSHPQMPKRIEDAKIAILTCPFEPPKPKTKHKVDIDTVEKFEALRDQERHYFDEMVQRCKDVGATLVICQWGFDDEANHLLMHRGLPAVRWVGGVELELIAIATGGRIVPRFQELTPDKLGKAGIVREKGFGTTKDRMLYIEQCANSKAVTVFIRGGNKMMIEETKRSLHDALCVARNLIRNNSIVYGGGSAEISCSLAVEAAADTIPGVEQYAVRAFADALDAVPMALAENSGLQPIDTLTAVKAQQIKENNPHLGIDCNDTGTNDMMEQNVFETLIGKKQQILLATQVVKMILKIDDVISPSRFA

SEQ ID NO: 3979 - protein, 122 aa, Hordeum vulgare
MALAFDDFGRPFVILREQESKSRLRGLDAHKANVAAGKAVARSLRTSLGPKGMDKILQSPDGDVTITNDGATILEQIDVNNQIAKLMVELSRSQDYEIGDGTTGVVDWWSWPGRSWNKLRNC

SEQ ID NO: 3980 - protein, 106 aa, Pteridium aquilinum
MALAFDEYGRPFIIIREQEQKSRVRGLDAQKANISAAKAVARILRTSLGPKGMDKMLQSPDGDVTITNDGATILEQMDVDNQIGKLMVELSRSQDYEIGDGQQEWW

SEQ ID NO: 3981 - protein, 535 aa, Beta vulgaris
MALAFDEYGRPFIILREQESMTRLRGLEAQKANISAGKAVARILRSSLGPKGMDKMLQSPDGDITITNDGATILDQMDVDNQIAKLMVELSRSQDYEIGDGTTGVVVMAGSLLEQAENLLDRGIHPIRIAEGYEVASRMAVEHLEKIAHKFEFGEANVEPLIQTCMTTLSSKIVNRCKRTLAEIAVKAVLAVADLERKDVNLDLIKVEGKVGGRLEDTELIYGIVVDKDMSHPQMPKKIEDANIAILTCPFEPPKPKTKHKVEIDTVEKFETLRKQEQQYFDDMVKQCKDVGATLVICQWGFDDEANHLLMHRNLPAVRWVGGVELELIAIATGGRIVPRFQELTPEKLGRAGLVREKAFGTTKDRMLYIEHCANSRAVTIFIRGGNKMMIEETKRSIHDALCVARNLIRNNSIVYGGGSAEIACSLAVEAGADRFPGVEQYAIRAFAEALDAIPMALAENSGLQPIETLSAVKHQQVKENNTCCGIDCSDVGTNDMREQFVFETLIGKQQQILLATQVVKMILKIDDVITPSEF

SEQ ID NO: 3982 - protein, 246 aa, Gnetum gnemon
MALAFDEFGRPFIIVREQEQKARVKGLDAQKANIAAAKAVARILRTSLGPKGMDKMLQSPDGDVTISNDGATILEQMEVENQIGKLMVELSRSQDYEIGDGTTGVVVTAGSLLEQAEQLLDRGIHPIRIAEGYEIASKIAVDHLDRIAHKFEFNLNNVEPLIQTCMTTLSSKIVNRCKRMLAEIAVKAVLAVADLERKDVNLDLIKVEGKVGGKLEDTELVYGIVVDKDMSHPQMPKKLRMRKLLS

SEQ ID NO: 3983 - protein, 535 aa, Tropaeolum majus
MALAFDEYGRPFIILKEQDQKTRLRGIDAQKANISAAKAVARILRTSLGPKGMDKMLSSPDGDVTITNDGATILEKMDVDNQIAKLMVELSRSQDYEIGDGTTGVVVMAGALLEQAEHLLERGIHPIRVAEGYEMASRIAVEHLEHISQKLDFSSTNIEPLVETCMTTLSSKIVNRCKRSLAEISVKAILSVADLERKDVNLDLIKVESKVGGKLEDTELIYGIAVDKDMSHPQMPKQIQDAHIAILTCPFEPPKPKTKHKIDIDSVEKFQTLRLQEQQYFDNMVQKCKDVGATLVICQWGFDDEANHLLMHRNLPAVRWVGGVELELIAIATGGRIVPRFQELTADKLGKAGLVREKAFGTTKDRMLYIEHCANSKAVTIFIRGGNKMMIEETKRSIHDALCVARNLIRNNSIVYGGGSAEVACSIAVDAAADKYPGVEQYAIRGFAEALDSISMALAENSGLQPIETLSAIKSQQIKENNPFYGIDCNDVGTNDMREQKVFETLIGKQQQILLATQVVKMILKIDDVISPSAF

SEQ ID NO: 3984 - protein, 535 aa, Physcomitrella patens
MALAFDEYGRPFIIIRDQETKSRVRGLDAQKANIMAAKAVARVLRTSLGPNGMDKMLQSPDGDVTITNDGATILEQMEIENQIGKLMVELSRSQDYEIGDGTTGVVVLAGALLEQAEVLLERGIHPIRVAEGYEMASKLAVENLTRIGQTFEFSPDNIEPLVQTCMTTLSSKIVGRCKRQLAEIAVKAVLAVADLERSDVNLDLIKVEGKVGGKLEDTELVYGIVVDKDMSHPQMPKEIRDAKIAILTCPFEPPKPKTKHKVDIDSVEKFEALQAAEKSYFNEMVQQCKDAGATLVICQWGFDDEANHLLMHENLPAVRWVGGVELELIAIATGGRIVPRFKELTPEKLGKAGLVREKGFGTTKDRMLYIEQCANSRAVTIFIRGGNKMMIEETKRSLHDALCVARNLIRDKAIVYGGGAAEISCSLAVEAAADKISGVEQYAMRAFADALDMVPMALAENSGLQPINTLTAVKAQQVKEQNPHLGIDCNDVGTNDMREQNVFETLIGKKQQVLLATQVVKMILKIDDVISPSSY

SEQ ID NO: 3985 - protein, 509 aa, Allium cepa
LEAQKSNISAGVAVARILRTSLGPKGMDKMLQSPDGDVVITNDGATILEQMDVDNQIAKLMVELSRSQDYEIGDGTTGVVVLAGSLLEQAEKLLERGIHPIRIAEGYETASRITVDHLEQISQKFVFSINDIEPLVQTCMTTLSSKIVNRCKRTLAEIAVKAVLAVADLERKDVNLDLIKVEGKVGGNLEDTELIYGIIVDKDMSHPQMPKHIEDAKIAILTCPFEPPKPKTKHKVDIDTVEKFQTLRQQEHKYFDDMVQKCKDVGATLVICQWGFDDEANHLLMHRNLPAVRWVGGVELELIAIATGGRIVPRFQELTPEKLGKAGLVREKAFGTTKDRMLYIEQCANSRAVTIFIRGGNKMMIEETKRSVHDALCVARNLIRNNSIVYGGGSAEISCSIAVEAAADKHPGVEQYAIRSFAEALDAVPTALAENSGLQPIDTLTAVKAQQIKESNSFLGIDCNDVGTNNMRQQDVFETLIGKQQQIMLATQVVKMILKIDDVITPTEY

SEQ ID NO: 3986 - protein, 535 aa, Zostera marina
MALAFDEYGRPFIIIKEQGQKSRIRGLEAQKTNINAGIAVSRILRSSLGPKGMDKMLQSPDGELTITNDGATILEQMDVDNQIAKLMVELSRSQDYEIGDGTTGVVVLAGALLEQAEKLLERGIHPIRVAEGYETASGVAVNHLEHISQKYDFSASEIESLVQTCMTTLSSKIVNRCKRMLAEIAVNAVLAVADLERKDVNLDLIKVEGKVGGKLEDTELIKGIIIDKDMSHPQMPKWIDDAKIAILTCPFEPPKPKTKHKVDIDTVEKFQTLRDQEQKYFDDMVQQCKDVGATLVICQWGFDDEANHLLMHRNLPAVRWVGGVELELIAIATGGRIVPRFQELTTEKLGKAGIVREKSFGTTKERMLYIEKCANSKAVTIFIRGGNKMVIEETKRSIHDALCVARNLIRNNSIVYGGGSAEIACAIAVESAADKHPGVEQYAIRSFAEALESIPMALAENSGLPSIETVTAVKSQQIKENNPFYGIDCNDVGTNDMQKQNVFETLIGKQQQMLLATQVVKMILKIDDVISPSDF

SEQ ID NO: 3987 - protein, 528 aa, Selaginella moellendorffii
GRPFIILREQEQKTRAKGLEAQKANIMAAKSVARILRTSLGPKGMDKMLQSGDGDVTISNDGATILEQMEVENQIGKLMVELSRSQDYEIGDGTTGVVVTAGALLEQAEILLERGIHPIRVAEGYEQAARIAVDHLSKISHSFEFSSTNIQPLVQTCMTTLSSKIVNRCKALLAEIAVKAVLAVADLERKDVNLDLIKVEGKVGGKLEDTELVYGIVVDKDMSHPQMPKRIEDAKIAILTCPFEPPKPKTKHKIDIDSTEKFEALREAEKKYFDEMVQKCKDVGATLVICQWGFDDEANHLLMHRGLPAVRWVGGVELELIAIATGGRIVPRFQELTPEKLGRAGIVREKSFGTTKDRMLYIEQCANSRAVTIFIRGASKMMVEETKRSIHDALCVARNLIRDNSIVYGGGSAEIACSIAVEAAADRIPGVEQYAVRAFADALDGVPMALAENSGLQPIDTLTAVKAQQIKEKNPHLGIDCNDVKTNDMKEQNVFETLIGKKQQILLATQVVKMILKIDDVITPSQYS

SEQ ID NO: 3988 - protein, 535 aa, Silene vulgaris
MALVFDEFGRQFLLFREQESKSRVRGIEAQKSNIAAAKSVANILRSSLGPKGMDKMLQSPDGDIVITNDGATILEQMDVNNQIAKLMVELSRSQDYEIGDGTTGVVVLAGALLEMAATLLDRGIHPIRISEGYEVASRIAVEHLENIAHKFEFEAGNIEPLVQTCMTTLSSKIVNRCKRSLAEIAVKAVMAVADLERKDVNLDLIKVEGKVGGKVEDTELIYGIVVDKDMSHPQMPKEIEDANIAILTCPFEPPKPKTKHKVEIDTVEKFETLRKQEQQYFDDMVQKCKDVGATLVICQWGFDDEANHLLMHRNLPAVRWVGGVELELIAIATGGRIVPRFQELTPEKLGRAGLVREKAFGTTKDRMLYIEHCANSRAVTIFIRGGNKMMIEETKRSIHDALCVARNLIRNNSIVYGGGSAEISCSIAVDATADRHPGVEQYAIRAFAEALEAVPMALAENSGLQPIETLSAVKAQQLQDNDPCCGVDCNDTGTNDMREQNVFETLIGKQQQILLATQVVKMILKIDDVITPNEY

SEQ ID NO: 3989 - protein, 535 aa, Ceratodon purpureus
MALAFDEYGRPFIIIRDQESKARVRGLDAQKANIMAAKAVARVLRTSLGPNGMDKMLQSPDGDVTITNDGATILEQMEIENQIGKLMVELSRSQDYEIGDGTTGVVVLAGALLEQAEVLLERGIHPIRVAEGYEMASKLAVDHLTHIGHKFDFSPDNIEPLVQTCMTTLSSKIVGRCKRQLAEIAVKAVLAVADLERSDVNLDLIKVEGKVGGRLEDTELVYGIVVDKDMSHPQMPKEIKNAKIAILTCPFEPPKPKTKHKVDIDSVEKFEALQAAEKTYFNDMVRQCKDAGATLVICQWGFDDEANHLLMHENLPAVRWVGGVELELIAIATGGRIVPRFQELTSDKLGKAGLVREKGFGTTKDRMLYIEQCANSRAVTIFIRGGNKMMIEETKRSLHDALCVARNLIRDKAIVYGGGAAEIACSLAVEAAADKISGVEQYAMRAFADALDMVPMALAENSGLQPINTLTAVKAQQVKEQNPHLGIDCNDVGTNDMREQNVFETLIGKKQQVLLATQVVKMILKIDDVISPSAF

SEQ ID NO: 3990 - protein, 527 aa, Vinca minor
MALAFDEFGRPFIIIKEQDSKTRLRGLDAHKSNISAGKAIARILRTSLGPKGMDKMLQSPDGDVTITNDGATILEQMDVDNQIAKLMVELSRSQDYEIGDGTTGVVVMAGALLEQAERLLERGIHPIRIAEGYEVASRIAFEHLEHIAHKYEFDATDIEPLVQTCMTTLSSKIVNRCKQSLAEIAVKAVLAVADLERKDVNLDLIKVEGKVGGKLEDTELIYGIVVDKDMSHPQMPKEINDAKIAILTCPFEPPKPKTKHKVDIDTVEKFQTLRQQEQKYFDDMVQQCKDVGASLVICQWGFDDEANHLLMHRNLPAVRWVGGVELELIAIATGGRIVPRFQELTAEKLGKAGLVREKAFGTTKDRMIYIEHCANSRAVTIFIRGGNKMMIEETKRSIHDALCVARNLIRNNSIVYGGGSAEISCSVAVEAAADKHPGVEQYAIRAFADALDAIPMALAENSGLQPIETLSAVKSQQIKENNPCCGIDCNDAGTTDMREQNVFETLIRKTAADFTRNTSCEDDSQDR

SEQ ID NO: 3991 - protein, 575 aa, Distylium racemosum
TLARQQRRTQRRSRVCLLGAVLGFESLYSITIPLLTKKRDGAGIDDVSGGHYYTNEQEQKIRVRGLDAQKTNIAAAKAVSRILRTSLGPKGMDKMLKSPDGDVTISNDGATILEQMDVENQIGKLMVELSRSQDYEIGDGTTGVVVTAGALLEEAEQLLDRGIHPIRIAEGYELASKIAVEHLDRIARKFEFSLNDVEPLVQTCMTTLSSKIVNRCKRMLAEIAVKAVLAVADLERKDVNLDLIKVEGKVGGKLEDTELVYGIVIDKDMSHPQMPKSIEDAKIAILTCPFEPPKPKTKHKVDIDTVEKFEALRDQERQYFDEMVQQCKDVGATLVICQWGFDDEANHLLMNRGLPAVRWVGGVELELIAIATGGRIVPRFQELTSDKLGKAGLVREKVFGTTKDRMLYIEKCANSKAVTIFIRGGNKMMIEETKRSVHDALCVARNLIRDNSIVYGGGSSEISCSLAVEAAADKIPGVEQYAVRAFADALDAVPMALAENSGLQPIDTLTVVKAQQIKENNPHLGIDCNDVGTNNMMEQNVFETLIGKKQQILLATQVVKMILKIDDVISPSGYS

SEQ ID NO: 3992 - protein, 459 aa, Olea europaea
MDVDNQIAKLMVELSRSQDYEIGDGTTGVVVMAGSLLEQAEKLLERGIHPIRIAEGYEMASRIAFEHLENVANKFEFDASNIEPLIQTCMTTLSSKIVNRCKRSLAEIAVKAVLAVADLERKDVNLDLIKVEGKVGGKLEDTELIYGIVVDKDMSHPQMPKQIEDAKIAILTCPFEPPKPKTKHKVDIDTVEKFQTLRQQEQKYFDDMVQKCKDVGATLVICQWGFDDEANHLLMHRNLPAVRWVGGVELELIAIATGGRIVPRFQELTSEKLGRAGLVREKAFGTTKDRMIYIEHCANSRAVTIFIRGGNKMMIEETKRSLHDALCVARNLIRNNSIVYGGGSAEISCSIAVEAAADKHPGVEQYAIRAFADALDAIPMALAENSGLQPIETLSAVKSQQIKENNHYCGIDCNDIGTNDMREQDVFETLIGKQQQILLATQVVKMILKIDDVISPSEY

SEQ ID NO: 3993 - protein, 499 aa, Flaveria ramosissima
MALAFDEYGRPFIILREQESKSRLRGLDAQKANIAAGVAVSRILRTSLGPKGMDKMLQSPDGDITITNDGATILEQMDVDNQIGKLMVELSRSQDYEIGDGTTGVVVMAGALLEQAEKLLERGIHPIRVAEGFEISSRIAVDHLEKIAHKFDFSATNIEPLVQTCMTTLSSKIVNRCKRSLAEIAVKSVMAVADLERKDVNLDLIKVEGKVGGKLEDTELIYGIIVDKDMSHPQMPKQIEDAKIAILTCPFEPPKPKTKHKVDIDTVEKFQTLRKQEQKYFDDMVQKCKDVGATLVICQWGFDDEANHLLMHRNLPAVRWVGGVELELIAIATGGRIVPRFQELTPEKLGKAGLVREKAFGTTKDRMLYIEHCANSKAVTIFIRGGNKMMIEETKRSIHDALCVARNLIRNNSIVYGGGAAEISCSIAVEAAADKYPGVEQYAIRAFADALDSVPMALAENSGLQPIETLSAVKAQQIKENNPCCGIDCNDTGTNDMRE

SEQ ID NO: 3994 - protein, 521 aa, Taxus baccata
MALAFDEYGRPFIILREQEQKSRVRGLDAQKANIAAAKAVARIIRTSLGPKGMDKMLTSPDGDVTISNDGATILEQMDVENQIGKLMVELSRSQDYEIGDGTTGVVVTAGALLEQAEQLLERGIHPIRIAEGYELASKIAVEHLNHIARKFEFNLINVESLVQTCMTTLSSKIVNRCKRMLAEIAVKAVLAVADLERKDVNLDLIKVEGKVGGKLEDTELVEGIVIDKDMSHPQMPKAIEDAKIAILTCPFEPPKPKTKHKVDIDTVEKFEALRGQERHYFDEMVQRCKDVGATLVICQWGFDDEANHLLMNRGLPAVRWVGGVELELIAIATGGRIVPRFQELTPEKLGKAGLVREKAFGTTKDRMLYIEHCANSKAVTVFIRGGNKMMIEETKRSLHDALCVARNLIRDNSIVYGGGSAEISCSLAVEAAADKIPGVEQYAVRAFADALDAVPMALAENSGLQPIDTLTAVKAQQIKENNPHLGIDCNDIGTNDMMEQNVFETLIGKNNRFYLRHRWSR

SEQ ID NO: 3995 - protein, 459 aa, Panicum virgatum
MDVDNQIAKLMVELSRSQDYEIGDGTTGVVVMAGALLEQAEKLLERGIHPIRVAEGYEMASRIAFEHLERISHKFEFSADNIEPLVQTCMTTLSSKIVNRCKRALAEIAVKAVLAVADLERKDVNLDLIKVEGKVGGKLEDTELIYGIVVDKDMSHPQMPKRIEDAKIAILTCPFEPPKPKTKHKVDIDTVEKFQTLREQEQKYFDEMVQKCKDVGATLVICQWGFDDEANHLLMHRNLPAVRWVGGVELELIAIATGGRIVPRFQELSPEKLGKAGLVREKSFGTTKDRMLYIEQCANSRAVTIFIRGGNKMMIEETKRSLHDALCVARNLIRNNSIVYGGGSAEISCSIAVEAAADRHPGVEQYAIRSFADALDAVPLALAENSGLPPIDTLTAVKAQQVKESNPHCGIDCNDVGTNDMKEQNVFETLIGKQQQILLATQVVKMILKIDDVISPSEY

SEQ ID NO: 3996 - protein, 509 aa, Selaginella moellendorffii
EAQKANIMAAKSVARILRTSLGPKGMDKMLQSGDGDVTISNDGATILEQMEVENQIGKLMVELSRSQDYEIGDGTTGVVVTAGALLEQAEILLERGIHPIRVAEGYEQAARIAVDHLSKISHSFEFSSTNIQPLVQTCMTTLSSKIVNRCKALLAEIAVKAVLAVADLERKDVNLDLIKVEGKVGGKLEDTELVYGIVVDKDMSHPQMPKRIEDAKIAILTCPFEPPKPKTKHKIDIDSTEKFEALREAEKKYFDEMVQKCKDVGATLVICQWGFDDEANHLLMHRGLPAVRWVGGVELELIAIATGGRIVPRFQELTPEKLGRAGIVREKSFGTTKDRMLYIEQCANSRAVTIFIRGASKMMVEETKRSIHDALCVARNLIRDNSIVYGGGSAEIACSIAVEAAADRIPGVEQYAVRAFADALDGVPMALAENSGLQPIDTLTAVKAQQIKEKNPHLGIDCNDVKTNDMKEQNVFETLIGKKQQILLATQVVKMILKIDDVITPSQYI

SEQ ID NO: 3997 - protein, 485 aa, Nicotiana benthamiana
MALAFDEFGRPFIILREQEQKTRLRGLDAQKANISAGKAVARILRTSLGPKGMDKMLQGPDGDVTITNDGATILEQMDVDNQIAKLMVELSRSQDYEIGDGTTGVVVMAGALLEQAEKLLERGIHPIRVAEGYEMASRIAVEHLERVANKFEFGLNDVEPLVQTCMTTLSSKIVNRCKRSMAEIAVKAVLAVADLERKDVNLDLIKVEGKVGGKLEDTELIYGIVVDKDMSHPQMPKQIEDAKIAILTCPFEPPKPKTKHKVDIDSVEKFQTLRQQEQKYFDDMVQKCKDVGATLVICQWGFDDEANHLLMHRNLPAVRWVGGVELELIAIATGGRIVPRFQELTPEKLGKAGVVREKSFGTTKDRMIYIEHCANSRAVTIFIRGGNKMMIEETKRSIHDALCVARNLIRNNSIVYGGGSAEISCSIAVEAAADKHPGVEQAYAIRAFADALDSVPMALAENSGLQPIETLSAVKAQQIKVIQLT

SEQ ID NO: 3998 - protein, 287 aa, Zea mays
MAAKAVASPLAFRRDVRGPLGRPAPGGCRSGTGTGTGLPGVLYWSGGAGGGSRLLAARARGRNRFGGGGGGRGASRDETAEEDEDEAADVVIVDAGDEEEYASDELSGFRGLVLDLSYRPVNVVCWKRAICLEFIGKAHVLEYYDQTVSSPSGSFYIPAVLRVPQLLQVVKRRRVKQSLSRKNILYRDDFTCQYCSCGDDLTIDHVIPISRGGKWEWENLVTACARCNSRKGQKTLEQANMKLRKIPRAPKEYDIMAVPLTKSAFRTLKRNHGLPEVWLQYLARPSP

SEQ ID NO: 3999 - protein, 279 aa, Setaria italica
MAAKVAAPLAFRRDVRGPLGRPLGCPSGRGMPGVLCWSSGTAGSKRLAAPAWLARARGKNRSAGGRSSTKDEAEEEEEAAEVVIVDAGDEEEFAADELSGFRGLVLDISYRPVNVVCWKRAICLEFMEKADVLEYYDQTVSSPSGSFYIPAVLRVPQLLQVVKRRRVKQSLSRKNILYRDEFTCQYCSSRDNLTIDHVIPISRGGKWEWENLVTACSRCNSRKGQKTLEQANMKLRKLPRAPKDYDILAVPLTKSAFRTLKRSQGLPEVWLQYLARPSP

SEQ ID NO: 4000 - protein, 277 aa, Panicum virgatum
MAAKVAAPLAFRRDVRGPLGRPCLGSRSGPQGALWCSSAGAAGSRPAPPVWLARARGRNRSAGGRSPTKDDAEEDEEAAEVVIVDGGDEEFAADELSGFRGLVLDISYRPVNVVCWKRAICLEFMEKADVLEYYDQTVSSPSGSFYIPAVLRVPQLLQVVKRRRVKQSLSRKNILFRDEFTCQYCSSRDNLTIDHVIPISRGGKWEWENLVTACSRCNSRKGQKTLEQANMKLRKIPRAPQEYDIMAVPLTKSAFRTLRRSQGLPEVWLQYLSRPSP

SEQ ID NO: 4001 - protein, 264 aa, Panicum virgatum
  misc_feature (189)..(189): Xaa can be any naturally occurring amino acid
MAAKVAAPLAFRRDVRGPLGRPCLGSRSGPQGALWCSSAGAAGSRPAPPVWLARARGRNRSAGGRSPTKDDAEEDEEAAEVVIVDGGDEEFAADELSGFRGLVLDISYRPVNVVCWKRAICLEFMEKADVLEYYDQTVSSPSGSFYIPAVLRVPQLLQVVKRRRVKQSLSRKNILFRDEFTCQYCSSRXNLTIDHVIPISRGGKWEWENLVTACSRCNSRKGQKTLEQANMKLRKIPRAPQEYDIMAALDEIRIQDAQEEPGVA

SEQ ID NO: 4002 - protein, 277 aa, Panicum virgatum
MAAKVAAPLAFRREVRGPLRRPCLGSRSGLQGALWCSSAGAGGSRPAPPVWLVRARGRNRSAGGRSSTKDDAEEDEEAAEVVFVDGGDEEFAADELSGFRGLVLDISYRPVNVVCWKRAICLEFMEKADVLEYYDQTVSSPSGSFYIPAVLRVPQLLQVVKRRRVKQSLSRKNILFRDEFTCQYCSSRENLTIDHVIPISRGGKWEWENLVTACSRCNSRKGQKTLEQANMKLRKIPRAPQEYDIMAVPLTRSAFRTLKRSQGLPEVWLQYLTRPSP

SEQ ID NO: 4003 - protein, 103 aa, Saccharum officinarum
MAKAGATAALLTVLVVLAASAEMAHGVCNLSSAGIRACQPAAAIRNPTDKPSAECCAALAGADLACLCRYKNAAGVWARFYGIDINRALGLPGKCGLAMPANC

SEQ ID NO: 4004 - protein, 103 aa, Panicum virgatum
MAKAQAMGALLTILVVLATSAEMAHGICNLSSNGIRACQPAAAIRNPTDQPSAVCCAALAGADLPCLCRYKNAAGVWVRFYRIDINRAMGLPGKCGLAMPANC

SEQ ID NO: 4005 - protein, 103 aa, Setaria italica
MAKAQAMGALLTVLVVLATSAEMAHGICNLSSTGIRACQPAAAIRNPTDQPSSECCAALAGADLPCLCRYKNAAGVWVRFYRIDINRAMALPGKCGLAMPANC

SEQ ID NO: 4006 - protein, 103 aa, Setaria italica
MAKAQAMGALLTVLVILATSAEMAHGICNLSSTGIRACQPAAAIRHPTDQPSAECCAALAGADLPCLCRYKNAAGVWVRFYRIDINRAMGLPGKCGLAMPANC

SEQ ID NO: 4007 - protein, 103 aa, Zea mays
MAKAGATAVLVTVLVVLAASAEMAHGVCNLSSAGIRACQPAAAIRNPTDQPSSECCAALAGADLACLCRYKNAAGVWVRFYRIDINRAMALPGKCGLAMPANC

SEQ ID NO: 4008 - protein, 103 aa, Panicum virgatum
MAKAQAMGALLTILVVLAMSSEVAHGICNLSSDGIRACQPAAAIRNPTDQPSAACCAALAGADLPCLCRYKNAAGVWVRFYRIDINRAMGLPGKCGLAMPANC

SEQ ID NO: 4009 - protein, 77 aa, Panicum virgatum
MAKAQAMGALLTILLVLAMSSEVAHGICNLSSDGIRACQPAAAIRNPTDQPSAACCAALAGPTCRACAGTRTPPACG

SEQ ID NO: 4010 - protein, 170 aa, Zea mays
MASLALRPVIPATTASSRTLTIVVGSRSCHAATLHRGFRSRRLITCKAEPSGGNSTLELGAGAAGLASSAVVAWSLYTLNTTGCGLPPGPGGALGAAEGVSYLVVAGLVGWSVTTKVRTGSGLPAGPYGLLGAAEGVAYLTIAAIAVVFGLQFFQQGSIPGPLPSEQCFG

SEQ ID NO: 4011 - protein, 164 aa, Panicum virgatum
MAPLALRPTISATAASTTLATVGSRCRHAANPRRRPTITCKAEPSGGNSTLELAAGAAGLASSATVAWSLYTLNTTGCGLPPGPGGALGAAEGVSYLVVAALVGWSVTTKARTGSGLPAGPYGLLGAAEGVAYLTVAAIAVVFGLQLFQQGSIPGPLPSEQCFG

SEQ ID NO: 4012 - protein, 164 aa, Panicum virgatum
MAPLALRPTISATAASTTLATVGSLCRHAAKSRRRPTITCKAEPSGGNSTLELAAGAAGLASSATVAWSLYTLNTTGCGLPPGPGGALGAAEGVSYLVVAGLVGWSVTTKARTGSGLPAGPYGLLGASEGVAYLTAAAIAVVFGLQFLQQGSIPGPLPSEQCFG

SEQ ID NO: 4013 - protein, 164 aa, Panicum virgatum
  misc_feature (57)..(58): Xaa can be any naturally occurring amino acid
MAPLALRPTISATAASTTLATVGSRCRHAANPRRRPTITCKAEPSGGNSTLELAAGXXGLASSATVAWSLYTLNTTGCGLPPGPGGALGAAEGVSYLVVAALVGWSVTTKARTGSGLPAGPYGLLGAAEGVAYLTVAAIAVVFGLQLFQQGSIPGPLPSEQCFG

SEQ ID NO: 4014 - protein, 510 aa, Sorghum bicolor
MVDLRLQVVATVLGMVALAAAAGGSSSSGKQSEFQEVTVDAIHQGFKNGSLTSTALVRFYLDQIARLNPLLHAVIEVNPDALAQAARADAERSASRGRCAVGLHGIPVLLKDNIATRDRLNTTAGSLALLGSVVRRDAGVVARLRRAGAVILGKANPSEWSNFRPVESGWSARGGQTLNPYVLSATPCGSSAGPGVAAAANMAAVTLGSETDGSILCPSSFNSVVGIKPTVGLTSRSGVIPITPLQDTIGPMCRTVSDAVHVLDVIVGYDELDAEATGAASKYIPHGGYTQFLRIHGLKGKRIGVLDVLFQGYDDMQLAVYEKHLDTMRQQGAVLIKDLDLATNFTDLGEQEILLMNAEFKLSINAYLSDLLYSPVRSLAQIIAFNEAHPVEERLKDFGQPNLIAAEETNGIGTRERAAIQRLKEISTNGLEKLMKEHQLDAIVGANFLSFRVLAIGGYPGIAVPAGYDKEGVPFAIYFGGLKGYEPRLIEIAYAFEQATKVRRPPSFKS

SEQ ID NO: 4015 - protein, 508 aa, Zea mays
MVDLRLQVVATVLGVALAAAAAGSSSGKQFEFQEATVDAIHQGFRNGSLTSTALARFYLEQIARLNPLLRAVIEVNPDALAQAARADAERAASRGRCAVGLHGIPVLLKDNIDTRDRLNTTAGSLALLGSVVRRDAGVVARLRRAGAVILGKANPSEWSNFRPVASGWSARGGQTLNPYVLSVTPCGSSAGPGVAAAANMAAVTLGSETDGSILCPSSLNSVVGIKPTVGLTSRSGVIPITPLQDTIGPMCRTVSDAVRVLDVIVGYDELDAEATGAASKYIPHGGYTQFLRTNGLRGKRIGVPDVFFQGYDDMQLAVYEKHLDTMRQQGAVVIMDLDIATNFTDLGNQEILLMAAEFKISINAYLSGLLYSPVRSLAQVIAFNEAHPVEERLKDFGQPDLIAAEKTNGIGTRERAAIRRLREISTNGLEKLMKERRLDAIVAPNSDASSVLAVGGYPGIAVPAGYDEQGVPFAICFGGLQGYEPRLIEIAYAFEQATKVRRPPTFKR

SEQ ID NO: 4016 - protein, 504 aa, Sorghum bicolor
DLRLRVLSAVMAFAAAAGSSSSGKQFEFEEATVDAIHQGFKNGSLTSTALVQFYLDQIARLNPLLHAVIEVNPDAVAQAERADAERSASGGRCAVGLHGIPVLLKDNIATRDRLNTTAGSLALLGSVVRRDAGVVTRLRRAGAVILGKANPSEWSNFRPVNSGWSARGGQTLNPYVLSASPCGSSAGPGVAAAANMAAVTLGSETDGSILCPSSRNSVVGIKPTVGLTSRSGVIPIMPLQDTIGPMCRTVSDAVHLLDAIVGYDEFDAEATGAASKYIPQGGYTQFLRIHGLRGKRIGVPDVFFHGYDGVQMAVYEKHLDTMRQQGAVVVKDLDIATNLTDLDDQESLLMNAEFKLSINAYLSDLLHSPVRSLAEVIAFNEAHPVEERLKDFGQPDLIAAEKTNGIGTRERAAIQRLKEISTNGLEKLVKEHQLDAIVAANSDASSVLAVGGYPGIAVPAGYDKQGVPFAICFGGLRGYEPRLIEIAYAFEQATKVRRPPTFKS

SEQ ID NO: 4017 - protein, 509 aa, Setaria italica
MVDLRVQVVAAVMGMALATAAAAGTSSSGRFEFQEATVDAIQLGFRNGSLTSTALVRFYLDQIARLNPLLRAVIEVNPDALAQAARADAERQASGGRCAAGLHGVPVLLKDNIATRDRLNTTAGSLALLGSVVPRDAGVVARLRRAGAVILGKANPSEWSNFRPVESGWSARGGQTLNPYVLSASPCGSSAGPGVAAAANMAAVTLGSETDGSILCPSSSNSVVGIKPTVGLSSRSGVIPITPRQDTIGPMCRTVSDAVHVLDAIVGYDKLDAEATGAASKFIPRGGYTQFLKMDGLRGKRIGAPAVFFQGYNDFQTAVYEKHLNTMREHGATVIKDLDIATNFTDLNAQETLLMIAEFKISLNAYLSDLLRSPVRSLSDVIAFNNAHPVEERLKDFGQPDLIAAEETNGIGVRERAAIRRLEEISANGLEKLMKEHQLDAIVAPNSDASSVLAVGGYPGIAVPAGYDKEGVPFAISFGGLRGYEPRLIEMAYAFEQATKVRRPPTFKR

SEQ ID NO: 4018 - protein, 505 aa, Panicum virgatum
MVDLRLQVVAAVMGAALATAAAGSGQFEFQEATVDAIQLGFRSGSLTSTALVRFYLDQIARLNPLLRAVIEVNPDALAQAARADAERAASGGRCAAGLHGVPVLLKDNIATLDRLNTTAGSLALLGSVVRRDAGVAARLRRAGAVILGKANPSEWSNFRPVASGWSARGGQTLNPYVLSATPCGSSAGPGVAAAANMAAVTLGSETDGSILCPSSSNSVVGIKPTVGLTSRSGVIPITPRQDTIGPMCRTVSDAVHVLDAIVGYDELDAEATGAASKYIPRGGYTQFLRIDGLRGKRIGVPAVFFQGYDDLHTAAYQKHLNTMRKHGAIVIKDIDIATNFSDLYDQETLLMNAEFKLSLNAYLSDLLRSPVRSLADVIAFNNAHPLEERLKDFGQPDLIAAEATNGIGPKERAAIRRLDEISTDGLEKLMREHRLDAIVAPNSDASSVLAVGGYPGIAVPAGYDREGVPFAICFGGLRGYEPRLIEMAYAFEQATRVRRPPTFKR

SEQ ID NO: 4019 - protein, 507 aa, Panicum virgatum
MVDLRLQVFAAVMGAALAAAAAAAGSGQFEFQEATVDAIQLGFRSGTLTSMALVRFYLDQIARLNPLLRAVIEVNPDALVQAERADAERSASGGRCAAGLHGVPVLLKDNIATRDRLNTTAGSLALLGSVVRRDAGVVARLRRAGAVILGKANPSEWSNFRPVESGWSARAGQTLNPYVLTATPCGSSAGPGVAAAANMAAVTLGSETDGSILCPSSSNSVVGIKPTVGLTSRSGVIPITPRQDTIGPMCRTVSDAVHVLDAIVGYDEFDAEATGAASKYIPPGGYTQFLRIDGLRGKRIGVPAVFFQGYDDLRMAAYEKHLNTMREHGAIVIKGLDIATNFSDLHEQETLLMNAEFKLSLNAYLSDLLRSPVRSLADVIAFNNAHPVEERLKDFGQPELIAAEETNGIGPKERAAIRRLDEISTEGLEKLMREHRLDAIVAPNSDASSVLAIGGYPGIAVPAGYDRVGIPFAICFGGLKGYEPRLIEMAYAFEQATKVRRPPTFKR

SEQ ID NO: 4020 - protein, 501 aa, Setaria italica
MAAPRLRVLAAVVALAAAGCGAFEFQEATVDAIQLGFRNGSLTSTALVRFYLDQIARLNPLLRAVIEVNPDALAQAARADAERQASGGRCAAGLHGVPVLLKDNIATRDRLNTTAGSLALLGSVVPRDAGVVARLRRAGAVILGKANPSEWSNFRPVESGWSARGGQTLNPYVLSASPCGSSAGPGVAAAANMAAVTLGSETDGSILCPSSSNSVVGIKPTVGLSSRSGVIPITPRQDTIGPMCRTVSDAVHVLDAIVGYDKLDAEATGAASKFIPRGGYTQFLKMDGLRGKRIGAPAVFFQGYNDFQTAVYEKHLNTMREHGATVIKDLDIATNFTDLNAQETLLMIAEFKISLNAYLSDLLRSPVRSLSDVIAFNNAHPVEERLKDFGQPDLIAAEETNGIGARERAAIRRLKEISANGLEKLMKEHQLDAIVAPNSDASSVLAVGGYPGIAVPAGYDKEGVPFAISFGGLRGYEPRLIEMAYAFEQATKVRRPPTFKR

SEQ ID NO: 4021 - protein, 502 aa, Setaria italica
MAAPRLRVLAAVVALAAAGCGAFEFQEATVEAIQLGFRNGSLTSAALVRFYLGRIARLNPLLRAVIEVNPDALAQAARADAERRASGGRLCAGGLHGVPVLLKDNIATRDRLNTTAGSLALLGSVVPRDAGVVARLRRAGAVILGKANPSEWSNFRAVKEGWSARGGQTMNPYDLSATPCGSSSGPGVAAAANMAAVTLGSETDGSILCPSSFNSVVGIKPTLGLTSRSGVIPITPRQDTVGPMCRTVSDAVHVLDAIVGYDKLDAEATGAASKYIPRGGYTQFLRADGLRGKRIGVCNVFFVGKDKEHLDVYSKHLDTMSQHGAILIGDLDIATNFSDLSDKEMLLMKAEFKLSLNAYLSDLLHSPVRSLSDVIAFNNAHPVEERLKDFGQNDLLDAEKTNGIGARERAAIRRLKEISANGLEKLMKEHQLDAIVALKWAASSVLAVGGYPGIAVPAGYDKEGVPFAISFGGLRGYEPRLIEMAYAFEQATKVRRPPTFKH

SEQ ID NO: 4022 - protein, 74 aa, Panicum virgatum
MVFFCFLVDQRRTVRSSKPAAGICSRCGGCASVADMETATRVCYLLTVHRRTWRAIICTFCGAMLKSYRHYRLY

SEQ ID NO: 4023 - protein, 74 aa, Unknown
  Sequence found in Organisms: Hordeum vulgare, Secale cereale, Triticum aestivum
MVFFCFLVDQRRKVRSSKPAAGICSRCGGCASVADMETATRLCYLLTVHRVTWRAIICTFCGAMLKSYRHYRLY

SEQ ID NO: 4024 - protein, 74 aa, Unknown
  Sequence found in Organisms: Pennisetum glaucum, Setaria italica
MVFFCFLVDQRRTVRSSKPAAGICSRCGGCASVADMETSTRVCYLLTVHRRTWRAIICTFCGAMLKSYRHYRLY

SEQ ID NO: 4025 - protein, 74 aa, Zea mays
MVFFCFLVEQRRTVRSSKPAAGICSRCGGCASVADMETATRVCYLLTVHRRTWRAIICTFCGAMLKSYRHYRLY

SEQ ID NO: 4026 - protein, 74 aa, Unknown
  Sequence found in Organisms: Festuca arundinacea, Lolium multiflorum
MVSFCFLVDQRRKVRSSKPAAGICSRCGGCASVADMETATRLCYLLTVHRVTWRAIICTFCGAMLKSYRHYRLY

SEQ ID NO: 4027 - protein, 76 aa, Oryza sativa
MVFFCFLVDQRRKVRSSKPAAGICSRCGGCASVADMETATRFCYLLTVHRATWRAIICTFCGAMLKSYRHYRLYAS

SEQ ID NO: 4028 - protein, 75 aa, Brachypodium distachyon
MVSMCFLVEQRRKVRSSKPAAGICSRCGGCASVADMETATRLCYLLTVHRVTWRAIICTFCGAMLKSYRHYRLHY

SEQ ID NO: 4029 - protein, 68 aa, Elaeis guineensis
MVFFCFLVDQRRMVRSSKPAAGICSRCGGCASVADMVTATRFCYVPVYRRTWRAIICTFCGALLKSYR

SEQ ID NO: 4030 - protein, 108 aa, Unknown
  Sequence found in Organisms: Sorghum bicolor, Triticum aestivum
MAAAALRPLTAPNAALPPRGPGKEHRTAITVPEFKRWVKQFDTDHDGRISRKELREAIRRRGAWFSGLRALFAVRRADRNRNGFVDDSEIEGLIDFAERELGFRITTE

SEQ ID NO: 4031 - protein, 105 aa, Saccharum officinarum
MATAAVPPNAAPPASRGPGKEHRTAITVPEFKRWVKQFDTDHDGRISRKELREAIRRRGAWFSGLRALFAVRRADRNRIGFVDDSDIEGLIHFAKRELGFRLTTE

SEQ ID NO: 4032 - protein, 102 aa, Zea mays
MAADGGPATSALEEALKPFQERASEAEIRIAKLEALLYNKDGPSGGSEATSSAVKDLQSKLDVVTAECLTEKEKNKKLTMENEKLQYRMTHLIRAIKEAESR

SEQ ID NO: 4033 - protein, 102 aa, Panicum virgatum
MAAGDGSATAALGEALKPFQERASEAEIRIAKLEALLYNKDGLNNGSETSSSAMKDLESKLDAVSAECLTEKEKNKKLIMENEKLQYRITHLIRAIKETESR

SEQ ID NO: 4034 - protein, 102 aa, Panicum virgatum
MAAGDGSATAALGEALKPFQERASEAEIRIAKLEALLYNKDGLNNGSETSSSAMKDLESKLDAVSAECLTEKEKNKKLIMENEKLQYRITHLMRAIKETESR

SEQ ID NO: 4035 - protein, 102 aa, Setaria italica
MAADDGRATAALDETLKPFQERASEAELRIAKLEALLYNQAGPNSGSEASSSAMKHLQSKLDAVSAECLTEKEKNKKLIIENEKLQYRITHLIRAIKEAESR

SEQ ID NO: 4036 - protein, 735 aa, Zea mays
MENSVRRVRCPRCRSVLEEPSAPVYQCGGCGTSLRAKNRTGTGTGSTGDAAGASPARSWLPPQSRHLDASDVASTSRSSTPTPPRVASTSRSGTPTPPDVGTSWHRDTDATGTRHGSGDLALVSAGTRGSGDVASTSSTPVATARSRRRQGTDATSRGSGDVASTSSTPDTTARIRRQDTDATTRGSGDVASTSSTPDASADTTRRGESGGPVPARNRVPEQAAAALIEKRGREQSAAGQEVRDDSEGRGTRDASGAESGVGGVGFSGGNRDATPELQDDTEKGMKRHDESNDAARKERRGEAAEQPRYDHDRRQELAPKSSAQPAAAQLAREDEAATAGEKAPSPSRHEVQEEHLRPLRKKILKTVDELKGDLSELFSKSPELNAPRARPPRLPRQEAYVSHAVAGAASGLPARARHVASAAEGHRGSVARAAKPRPAAAPPRGLPSRRYRQCRAHPCCHDVDPRPCHHGHGCCGHHGKPECSSCRGYCCRPRALEPSAPRKPPAAKEPKRRLPPRNHCRPVLKGAPFIVCSSCFKLVQVPADFAVSTRMVRRMRCGSCSTVLSYSYRDPARKKAYQDSVNRCSTDGSELHGGTGDQRSDPFAPFIDGFGLSSYSTEDERRLPVSRNTSFDTLDGTKGVGRLHRLMGYGSASELLRHSPDLYESFSERTTPDVRQHDTKGKGVCIDDDDYDYDLDDTDDEDIGALKRSARKGSGWTLPWIPGKRQGDSGAIRIK

SEQ ID NO: 4037 - protein, 681 aa, Zea mays
MDAAELPLVYHIGLVLAALWAAAAVGFRGSLLYLLAFLYLYMVNARCAVRLRKRIQHEEMKSAYQRRLLSDAESARWLNHAIDKMWPVCMEKIVSKLLRPIIPWFLDKFKPWTVSKASIQELYMGRNPPIFTSMRVLPETSDDDHLVLELGLNFLSAEDMSAVLAMQLHKSVGLGMTAKMHLTSMHVEGKILVGVKFVRSWPFLGRVRLCFVEPPYFQMAVKPLINHGLDVTEFPGISGWLDKLMDTAFGQTLVEPNVIVINVEKFASTPSENNWFSIEERPPIAYVKLEILEGTDMKPSDINGLADPYVKGHLGPFKFQTQIQRKTLSPKWFEEFKIPITSWEATNELVMEVRDKDPMFDDSLGQCTISLHDLRGGQRHDKWISLNNVKKGRIHLAVTIDDISEDQNTSSLDQSLKQADTELPVSTSVCSEVDASEPPEEKKVLMDEVEHINIDGQEQPGGLYVHRPGTGVPRTWESRKGRARNPDTQIHQEVDKQKEVPTPKGSGQGGLFNVGSFFRWNSRKGSSRNLDASPPATPGSQSVTELDPKLPQTPRPNLKELGEKRTSIKIVVDEEASPADKVGGAENSGEDVAKVIEKNAGEPGRSLTSTLSRKICRRRADDRLSDIPEKIEARGSKPVSEGPILVRGEPMITVDHPTTEHSDGGGTEQDAVGAKVATQTS

SEQ ID NO: 4038 - protein, 682 aa, Setaria italica
MDAAELPLVYHIGLVLAALWAAGALGIRHSFLFLLAFLYLYMVNARCAMRLRKRIQHEEMKSAYQRRLLSDAESVRWLNHAINKMWPICMEKIVSQLLRPIIPWFLDKFKPWTVSKASVQELYMGRNPPMFTSMRVLPETSDDDHLVLELGMNFLSAEDMSAILAMQLHKSVGLGMTANMHLTSMHVEGKILVGVKFVRSWPFLGRVRLCFVEPPYFQMTVKPLINHGLDVTEFPGISGWLDKLMDTAFGQTLVEPNMIVINVEKFASTPSENNWFSIEERPPIAYVKLEILEGTDMKPSDINGLADPYVKGRLGPFKFQTEIQRKTLSPKWFEEFKIPITSWEASNELVMEVRDKDPMFDDSLGGCTIDLHELRGGQRHDKWISLNNVKKGRIHLAVTVEDISEDKNVSCSDEPLKKADAELPVLTSADSTTDAGELPEEKKVLMDEVEHINIDGQEQPGGLYVHRPGAGVPKTWESRKGRARAPDTQIYQEVDKSKEIPAPKSSGHGGLFNLGSFFRKNSRKESFKGDPSLPTTPGSQSVTELDPKLPKTPHPNLKELGEKRTSIKLVVNEEASPASKVGDTDNSTEDVAKVIQKNAGEPGRSLTSTLSRNISRKREEDRLSDIQEQIEAHGSESVTVSEEHIPVEGEPIEKEGHQTTEHENGDGAEEDSVGAEIATQAS

SEQ ID NO: 4039 - protein, 225 aa, Panicum virgatum
MDAAEVPLVYHIGLVLAALWAAGALGIRHSLLFLLAFLYLYMVNARCAMRLRKRIQHEEMKSAYQRRLLSDAESVRWLNHAIDKMWPICMEKIVSQLLRPIIPWFLDKFKPWTVSKASVQELYMGRNPPMFTSVRVLPETSDDDHLVLELGMNFLSAEDTSVVLAMQLHKSVGLGMTANMHLTSMHVEGKILVGVKFVRSWPFLGRVRLCFVEPPLFSDDCETTH

SEQ ID NO: 4040 - protein, 659 aa, Panicum virgatum
MDAAELPLVYHIGLVLAALWAAGALGIRHSLLFLLAFLYLYMVNARCAMRLRKRIQHEEMKSAYQRRLLSDAESVRWLNHAINKMWPICMQKIVSQLLWPIIPWFLDKFKPWTVSKASVQELYMGRNPPMFTSMRVLPETSDDDHLVLELGMNFLSAEDMSVVLAMQLHKSVGLGMTANMHLTSMHVEGKILVGVKFVRSWPFLGRVRLCFVESPYFQMTVKPLINHGLDVTEFPGISGWLDKLMDTAFGQTLVEPNMVVINVEKFASTPSENNWFSIEERPPIAYVKLEILEGTDMKPSDINGLADPYVKGRLGPFKFQTQIQRKTLSPKWFEEFKIPITSWEASNELLMEVRDKDPMFDDLLGECTIDLHELRGGQRHDKWISLNNVKKGRIHLAVTVEDVSEDKNVSYLDESLRKADAELPVSTKVDSALDAGELPEEKKVLMDEVEHINIDGQEQPGGLYVHRPGTGVPKTWESRKGRARSPDTQIYQEVDKSKEIPTPKSSGQGGLFNLGSFFRKNSKKGSLNPSLPTTTGSVTELDPKLPKTPRPNLKEIGEKRTSIKLVVNEEASPASKVGDADNSTEDVAKVIEKNAGEPGRSLTSTLSRNVSRKRAEDNLSEIPEQVEAHGSESVIEEHMPIEGEPVEIQGPSDNGTWQG

SEQ ID NO: 4041 - protein, 630 aa, Panicum virgatum
MRLRKRIQHEEMKSAYQRRLLSDAESVRWLNHAIDKMWPICMEKIVSQLLRPIIPWFLDKFKPWTVSKASVQELYMGRNPPMFTSVRVLPETSDDDHLVLELGMNFLSAEDTSVVLAMQLHKSVGLGMTANMHLTSMHVEGKILVGVKFVRSWPFLGRVRLCFVEPPYFQMTVKPLINHGLDVTEFPGISGWLDKLMDTAFGQTLVEPNMIVINVEKFASTPSENDWFSIEERPPIAYVKLEILEGTDMKPSDINGLADPYVKGRLGPFKFQTQIQRKTLSPKWFEEFKIPITSWEASNELFMEVRDKDPMFDDLLGECTIDLHELRGGQRHDKWISLNNVKKGRIHLAVTVEDVSEDKNVSCLDESLRIADAELPVSTSVDSALDAGELPEEKKVLMDEVEHINIDGQEQPGGIYVHRPGTGVPKTWESRKGRARSPDTQIYQEVDKSKEIPAPKGSGQGGLFNLGSFFRKNSKKGSLNPSLPTTPGSQSVTELDPKLPKTPRPNLKELGEKRTSIKLVVNEEASPPSKVGDADNSTEDVAKVIEKNAGEPGRSLTSTLSRSVSRKRAEDKLSEIPEQIEAHGSESVSEEHTPIEGQPIEIQGHQTTEHGKGDGAEEDALGAKVATQAL

SEQ ID NO: 4042 - protein, 387 aa, Zea mays
MSETESAAAAPVAAAESKPRRLRGHKKGAVTCCVASSARPGVVASSGEDGCLCWFDLRTKDALLTMEAANKPISSICFKPGNEDFVYISAGNEILSFDVRMGTQSKPLETYNYNRDEINQIAVSSKGFLAAADDSGDVKIVNTIQKCLYKRLREAHTSICSSVQFIPWRPWTAITGGLDSKLAAWDFSKGRTLFSIDYGSPELQNGSSSGSAGQCFNPAFVHSVAVSEEGILGGLYKVCAVARGDGAVDVVDLEYELAPAKSKGPPRAAILTTRSKGAELGDGSCNQSRAKRIHLDYTMGGHTAAVSCVAFSAFGEKGKFLISGGNDASVKLWDWSKGFYSETNSKVDLVLDIDVKKKVNWLCTAPTDSDNLIVCDTSKVVKVYSFR

SEQ ID NO: 4043 - protein, 390 aa, Setaria italica
MSETESAAAAVPAPASAEERKPRRLRGHKKGAVTCCVASSARPGVVASAGEDGCLCWFDLRTKDVILTIEAANKPVSSICFKPRNEDFVYASAGNEILSFDVRMGPQPKPLETYNYNRDEINQIAVSSKGFLAAADDSGDVKIVNTIQKCLYKRLREAHTSICSSVQFIPWRPWTAITGGLDSKLAAWDFSKGRTLFSIDYGSPELQNGSSSGSAGQCFNPAFVHSLAVSEEGILGGLYKVCAVARGDGAVDVVNLEYELAPAKSKGPPWAATSTMSSKRTEVGDGSSNQSQVKRIHLDYTMGGHTAAVSCVTFSAFGEKGKFLVSGGNDASVKIWDWSKGFSSETNSNAELVLDIDVKKKVNWLCTTPTDSDNLIVCDTSKVVKVYNFR

SEQ ID NO: 4044 - protein, 388 aa, Panicum virgatum
MSEAESAAAAVPAAAAERKPRRLRGHKKGAVTCCVASSARPGVVASAGEDGCLCWFDLRTKDVLLTIEAANKPISSICFKPGNEDFVYASAGNEILSFDVRMGPQSKPLETYNYNRDEINQIAVSSKGFLAAADDSGDVKIVSTIQKCLYKRLREAHTSICSTVQFIPWRPWTAITGGLDSKLAVWDFSKGRTLFSIDNGSPELQNGSSSGSAGQCLNPAFVHSLAVSEEGILGGLYKVCAVARGDGAVDVVDLEYELAPSKSKGPPRLATSTMSSKRTEPGDGSSNQCQVKRIHLDFTMGGHTAAVSCVAFSAFGEKGKFLVSGGNDSSVKIWDWSKGFSSETNSDAELVLDIDVKKKVNWLCTTPTDSDNLIVCDTSKVVKVYNFR

SEQ ID NO: 4045 - protein, 715 aa, Secale cereale
NSVISGCFSNGWHGRAVEHFSEMWFEGLEIDSVTMLSVLPACAELGYEPVGRVIHGYSVKTGLLWELESLERGVDDNLGSKLVFMYVKCGELGYARKVFDAMSSKSNIHVWNLLMGGYAKVGEFQESLFLFEKMHDSGIAPDEHTVSCLVKCVTSLYSGRDGLVVHGYLLKLGFGAQCAVCNAMISFYAKSNMTEDAILVFDGMPHRDVISWNSIISGCTFNGLYSKSVELFVRMWLQGQELDSATLLSVLPACAQLRHWFLGRVVHGYSVKTGLIGETSLANVLLDMYSNCSDWRSTNKIFRNMDQKNVVSWTAIITSYTRAGLFDKVAGLLQEMALEGIRPDTFAITSALHAFAGNESLKDGKSVHAYAIRNGMEKVLPVTNALMEMYAKCGNMVEARLIFYGVMSKDMISWNTLIGGYSRNNLANEAFNLFTEMLLQFRPNAVTMTCILPAAASLSSLERGREMHTYALRRGYLEDDFVANALMDMYVKCGALLLARQLFDRLSSKNLISWTIMVAGYGMHGRGRDAIALFEQMRASGIEPDAASFSAILYACSHSGLRDEGWRFFDAMRREHRIEPRLKHYTCMVDLLTNTGNLREAYEFIESMPIEPDSSIWVSLLNGCRIHRDIKLAEEVAERVFELEPENTGYYVLLANIYAEAERWEAVRKLRNKIGGRGLREKTGCSWIEARGEGSGLHRGQPESSAGGEDRRVPG

SEQ ID NO: 4046 - protein, 388 aa, Hordeum vulgare
MSETETVAAAPAATSMERKPRRLRGHKKGAVTCCVASSARPGVVASSGEDGCLCWFDLRTKDVLLTIEAANKPISSLCFKSGNEDHVYVSAGNEILSFDIRMGSQSKPLETYTYNRDEINQIAVSSKGFLAAADDSGDVKIVNTTQKCLYKRLREAHTSICSSVQFIPWRPWTVITGGLDSKLAVWDFSKGRTLFSIDYGSPELQNSSSSGSTGQCFNPAFVHSVAVSEGGILGGLYKVCAVARGDGAVDVVDLEYELAPAKSRGPSRAGGSTMSSKITDLGDGSNNQCQGRRIHFDYSMGGHTAAVSCVAFSAFGEKGKFLVSGGNDSSLKVWDWSKGFSPETNSNSELVLDIDVKKKVNWLCTAPTDSDNLIVCDTSKVVKVYNFP

SEQ ID NO: 4047 - protein, 386 aa, Triticum aestivum
MSETETAAAAATSTERKPRRLRGHKKGAVTCCVASSARPGVVASSGEDGCLCWFDLRTKDVLLTIEAANKPISSICFKPGNEDHVYVSAGNEIMSFDIRMGSQSKPLETYNYNRDEINQIAVSSKGYLAAADDSGDVKIVNTTQKCLYKRLREAHTSICSSVQFIPWRPWTAITGGLDSKLAVWDFSKGRTLFSIDYGSPELQNSSSSGSTGQCLNPAFVHSVAVSEEGILGGLYKVCAVARGDGAVDVVDLEYELAPAKSKGPSRAGGSTMSSKTTDLGDGSNNQCQRRRIHLDYSMGGHTAAVSCVAFSAFGEKGKLLVSGGNDASLKVWDWSKGFSPETSSNSELVLDIDVKKKVNWLCTAPTDSDNLIVCDTSKVVKVYNFL

SEQ ID NO: 4048 - protein, 382 aa, Brachypodium distachyon
MSETGAAAGASSTERKPRRLRGHKKGAVTCCVASSARPGVVVSSGEDGCLCWFDLRTKDVLLTIEATNKAISSVCFKAGNEDFVYVSAGNEILSFDVRMGSQSKPLETYNYNREEINQIAVSSKGFLAAADDSGDVKIVNTMQKCLYKRLREAHTSICSSVQFIPWRPWTAITGGLDSKLAVWDFSKGRTLFSIDYGSPEMQNRSSSASAGQCLNPAFIHSVAVSEEGGLYKVCAVARGDGAVDVVDLEYELAPAKSKGPSRAGGSAMSSKGTDLGNGSSNQSQQKRILLDYTMGGHTAAVSCVAFSAFGEKGKFLVSGGNDASVKLWDWSKGFSSETNSNSELVLDIDVKKKVNWLCTAPTDSDNLIVCDTSKVVKVYNFP

SEQ ID NO: 4049 - protein, 440 aa, Zea mays
MDPSVSSSPLRLSAGTRASPAPTPRPPSLVVAAGRHQPAAATATTRLRAVSPSPPPPSPVGSFGFDALKETFSVDVAAAGARPLRVPLAAPFTIASSRLAALSNVAVRVELRSGAVGWGEAPVLPSVTAEDQPAALGAAARACAALAAAPAAPLGALLQDVAGVLPGHAFASARAGVEMALIDAVANSIRIPLWRLFGGASDSVTTDITIPIVTPNEAAQLAAKYRGQGFQTLKLKVGKNLNSDIEVLKAIRLVHPDCSFILDANEGYTANQAIEVLDRLNEMGVTPVLFEQPVHRDDWEGLRDVSAVAMEKYKVAVAADESCRSLLDAQKIIQGNIAHVINIKLAKLGVLGALEIINAARKSNTALMIGGMVETRIAMGFAGHLAAGLGCFSFVDLDTPLLLSEDPVYGGYEAFGPLYKFTNARGHGGFLHLDNNDASK

SEQ ID NO: 4050 - protein, 402 aa, Panicum virgatum
ARRLLLLHAPPRRLAVPSPRPPWSRSASARSRRPFSVDVAAAEARALDVPLAAPFTIATSRLEAVSNVAVRVELRSGAVGWGEAAVLPSVTAEDQPAALAAAGRACDALAGAPAAPLGAMLQEVAGVLPGHAFASARAGVEMALIDAVANSIRIPLWRLFGGASDTVTTDITIPIVAPNEAAQLAAKYRGQGFQTLKLKVGKNLNSDIEVLKAIRLVHPDCSFILDANEGYTADQAIEVLDRLNEMGVTPVLFEQPVHRDDWEGLRDVSIAAMEKYKVAVAADESCRSLLDAQKIIHGNLAHVINIKLAKLGVLGALEIIDAARKANVALMIGGMVETRIAMGFAGHLAAGLGCFSFIDLDTPLLLSEDPVYGGYEAFGPLYKFTNARGHGGFLHLDNNGSK

SEQ ID NO: 4051 - protein, 289 aa, Zea mays
MMNEHREEDALRGQAVKNQKAIWDKTMEMRFLLQKAFSTSNKLPQESIRTRFCNHDKQIEQAYDDLLNSTKHTLSSMMELQEALLESNQATKDANEIPSASNGDNDEWSEVQRLQARITTFRNTEIDKWHRKIQVTTGAAALKGKLHAFNQNISDQVAGYMRDPSRMINRMYLTNSAVRVFGKDVGEPGTAEEGHIMEGDPELIDDSEFYQQLLKEFLESCDRGASKSAFYSLKKQQVKKRKLVDRRASKSRKIRYHVHEKITNFMAPEPMVLPPMAPKLFENLFGNSS

SEQ ID NO: 4052 - protein, 289 aa, Setaria italica
MMNQHREEDALRGCAVKNQKAIWDKTLEMRFLLQKAFSTSNKLPQEPIKTRFCNHDKEIEQAYENLVTSSKQTLASMTELQEALLESNQAVKDANEIPSAPNGENDEWSEVQRLQTRITTFRNTEIDKWQRKIQVTTGAAALKGKLHAFNQNISDQVAGYMRDPSRMINRMYLTKSAVGVFGEDVGEHGAADEGRIVEGDSELIDDSEFYQQLLKEFLESCDRGASESAFYALRKQQVKKRKLVDRRASKSRKIRYNVHEKITNFMAPVPMALPPMAPKLFENLFGTSN

SEQ ID NO: 4053 - protein, 343 aa, Pennisetum glaucum
PVARGHLHPPPRPLLLPDCLVVCCSARGEPSQGRRNFFWDSSTEARPPCGESLKMMNQHREEDALRGRAVKNQKAIWDKTLEMRFLLQKAFSTSNKLPQEPIKTKFCNHDEEIEQAYEDLLTSSKQTLASMTELQEALLESNQAVKDATEIPSAPNGENDEWSEVQRLQTRITTFRNTEIDKWQRKIQVTTGAAALKGKLHAFNQDISDQVASYMRDPSRMINRMYMTKSAVGVFGEDVREPGAADEGRIVEGDPELIDDSEFYQQLLKEFLESCDKGVSESAFYAIRKQQVKKRKLVDRRASKSRKIRYNVHEKITNFMAPVPMDLPPMTPKLFENLFGMSN

SEQ ID NO: 4054 - protein, 197 aa, Panicum virgatum
MPMKFLLSQMERMTSGQKYKRLQTRITTFRNTEIDKWQRKIQVTTGAAALKGKLHAFNQNISDQVAGYMRDPSRMINRMYLTKSTVGVFGEDAGEPGAVEEGHIVEGDPELIDDSEFYQQLLKEFLESCDRGSSDSAFYTLQKQQVKKRKLVDRRASKSRKIRYHVHEKITNFMAPVPMAVPPMAPKLFENLFGTTN

SEQ ID NO: 4055 - protein, 180 aa, Panicum virgatum
MMNQHREEDALRGRAVKSQKAIWDKTLEMRFLLQKTFSTSNKLPQEPVKARFCNHDNEVEKAYEDLFDSSKQTLGSMMELQEALLQSNHAAKDANEIPSVANGENDEWSEVQRLQTRITTFRDTEIDKWQRKIQVTTGAAALKGKLHAFNQNISDQVAGCMRDPSKIINRMYLTKSAVGV

SEQ ID NO: 4056 - protein, 507 aa, Zea mays
MGRPQPARAGAINIEACARPIAVDHRISLPYYFRIAGSLLRQANIYRNESNLLDLYVILLRYSSLLCETIPKHRDYHAFKLREKAFFDKLIDIIKELETLKPVVQRQVVEHNRGSTVEFNTNSLNGNYGTTRRIEQCTPSSYTPQTFVGSSNGALQKPFHAGRQVASLSSVQKQFMNLPYPKEETLARHSILGPNGLNGRWNGPVTGIKVQYPSNFELTQNGITSLVPSILNQDDLHGSNTAPAPPPPSSSSNDNDNMKSVLSLDDGRWSVPAEEHTPLPSANLEEELFQLNIKQPSPPPVLAEVQRPISPSRVADPTPGLPTSGTARFQNLHVPIKLMECFLRVAESNTKRSLETCGVLAGTLKNRTFYVTTLIIPKQKSTSDTCEATNEEELFEVQDTYSLFTLGWIHTHPTQSCFLSSIDVHNHYSYQVMLPEAIAIVMAPTDTRKHGIFHLTDPGGMGVIHDCQERGFHPHKAPLDGSPIYEQCSHVYMDTDIKFDMIDLRQR

SEQ ID NO: 4057 - protein, 506 aa, Zea mays
MGPPQPARPGVINIEACARPIAVDHRISLPYYFRIAGSLLRQANIYRNESNFLDLYVILLRYSSLLCETIPRHRDYHAFKLREKAFFDKLVDVIKELETLKPVVQRQIADHNRGGTVESNMNSLNGDNGTTHRIEQHTPSSYTPQPFVGSTNGASQKSFHAGRQVASLLSVQKQYMNLPYPKEETLARHSILGPNGLNGRWNGPVTGIKVQYPSNFELTQNDITSLVPSILNQDDPQGPSTAPPPPDSPSNDNDDMKSVLSLDDGRWSVSADEHTSFTSANLEEELLQLNIKQPSPPPVLAEVQRPISPSRVADPTPGLPTSGTARFQNLHVPIKLMDCFLRVAESNTKRSLETCGVLAGTLKNRTFYVTTLIIPKQKSTSVTCEATNEEELFEVQDMGSLFTLGWIHTHPTQSCFLSSVDLHNHYSYQVMLPEAIAIVMAPTDTTRKHGIFHLTDPGGMGVIHDCQERGFHPHKAPLDGSPIYKQCSHVYMDTDIKFDMIDLRER

SEQ ID NO: 4058 - protein, 510 aa, Setaria italica
MAPPQPARGGAINIEACARPIAVDNRISLPYYFRIAGSLLRQANIYRNEKNILDLYVILLRYSSLLCETIPKHRDFLAFKLREKAFYDKLNDVIIELESLKPVVQRQVAEHNRGGTVESNTNSLNGTYATSRRIEQHTPSLYTPQPFVGSANGALQKSFHVGRQVPSLPSVQPDKQIQKQFMNLPYPSEETLARHSILGPNGLHGRWNGPVTGIKVQYPSNFELTQSDMTSLVPSISNQDGSNGPGTAPPDSSTNDNEDMKSVLSLDDGRWSVPAEKRTPLPSASLEEELFQLNIKQPSPPPVLAEVQRPISPSSVADPTPGLPTSGTARFQNLHVPIKLMECFLRVAESNTKRSLETCGVLAGTLKKRTFYVTTLIIPKQKSTSNTCEATNEEELFEVQDTGSLFTLGWIHTHPTQSCFLSSIDLHNHYSYQVMLPEAIAIVMAPTDTTRKHGIFHLTDPGGMGVIHDCQERGFHPHKAPLDGSPIYEQCSHVYMDTDIKFDMIDLRER

SEQ ID NO: 4059 - protein, 510 aa, Panicum virgatum
MGPPQPARGGPINIEACARPIAVDNRISLPYYFRIAGSLLRQANIYRNEKNILDLYVILLRYSSLLCETIPKHRDFLAFKFREKAFFDKLTDVIKELESLKPVVQRQVAEHNRGGTVESNTNSLNGTYATTRRIEQHSPSLYTPQPSVGSANGALQKSFQIGRQVPSLPSVQHDRQMHKQFMNLPYPSEETLARHSILGPNGLHGRWNVPVTGIKVQYPNNFELTQNDMTSLVPSILNQDGSFGPSTSPPDSSTNENEDMKSVLSLDDGRWSVPAEEQTLIPSASLEEELFQLNIKQPSPPPVLAEVQRPISPSRVADPTPGLPTSGTARFQNLHVPIKLMECFLRVAESNTKRSLETCGVLAGTLKKRTFYVTTLIIPKQKSTANTCEATNEEELFEVQDSCSLFTLGWIHTHPTQSCFLSSIDLHNHYSYQVMLPEAIAIVMAPTETTRKHGIFHLTDPGGMGVIHDCQERGFHPHKAPLDGSPIYEQCSHVYMDTDIKFDMIDLRER

SEQ ID NO: 4060 - protein, 510 aa, Panicum virgatum
MGPPQPARGGPINIEACARPIAVDNRISLPYYFRIAGSLLRQANIYRNEKNILDLYVILLRYSSLLCETIPKHRDFHAFKLREKAFFDKLSDVIKELESLKPVVQRQVAEHNRGGTVESNTNSLNGTYATTHRIEQHTPSLYTPQTFVRSANGALQKSFQIGRQVPSLPSVQKDRQMHKQFMNLPYPSEETLARHSILGPNGLHGRWNVPITGIKVQYPNNFELTQGDMTSLVPSILNQDGSLGPSTAPPDSSTNDNEDMKSVLSLDDGRWSVPAEEQTLIPSANMEEELFQLNIKQPSPPPVLAEVQRPISPSRVADPTPGLPTSGTARFQNLHVPIKLMECFLRVAESNTKRSLETCGVLAGTLKKRTFYVTTLIIPKQKSTANTCEATNEEELFEVQDSCSLFTLGWIHTHPTQSCFLSSIDLHNHYSYQVMLPEAIAIVMAPTETTRKHGIFHLTDPGGMGVIHDCQERGFHPHKAPLDGSPIYEQCSHVYMDTDIKFDMIDLRER

SEQ ID NO: 4061 - protein, 571 aa, Zea mays
MFNWNDEQHQVRDAIWAEFNECDDHFGLCPKGAKKNPIFISGVRKNNEEEVASIAAITEQSAGVQNGHQGMEKQTASHTSAHISATQIDMESWPELPSLNPTLDRNYSDDNIASTYLDFCAATSLQEVTRNSTEQLDGKSEVFGNDQEEKSNSFLDCDWGNIGGFDDFDRLFSHSDSIFGNEIVANDSDFLSASSNLMDTAVLSIPVPVEAHKRPVWSRRKPEERGKSKISSSTSGFSHSKVESSSTNLQTPMEPVQTPQYALFQDSKKIGEVQHANQFMFPGYGYPPAYPFPTIPLVSNIQAEGYQTKPAGTSYRTSEDYLKQSSSTEMSQDIPSRPLTMTPQEKIEKLRRRQQMQALIAIQQQQQQFGQQGPGSDTMVSQAYTPGNKNPDSLGSSIVIDENTNKVISPEMIPTDHDRVHKSSAISDDPFIEEKIYYQLQDALDKLDTKTRLCIRDSLLRLAHSATERQIDGDRSTNKTNKDEDEASEDASTRKTRSPNKEAETTTNPIDRIVAHLLFHRHCSKVAKATKEIISSIPLTLEPEPKVPLGTPRVPSKDQRDEQEIVLQPSQ

SEQ ID NO: 4062 - protein, 267 aa, Zea mays
MAQTNGNDPFSPPVSQERVVITNKHGERLVGLLHHTASNKIVVLCHGFIATKNDSLILDLAEALTKEGISVFRFDFSGNGESEGQFEYGNYRKEADDLHSVVLYLCQKSYDIAAVVGHSKGGDVVILYASVHDDVGTIVNLSGRFDLRKGIEERIGEGSIDKINKEGYLDVKDKSENASYRVTKESLMERLNTDMRAASVSISKGCRFLTVHGSADKTIPVEDAHEFAKHIPNHELRVIEGANHNYTSHRKEVADAVVDFITSNVTV

SEQ ID NO: 4063 - protein, 797 aa, Panicum virgatum
MTALLYLLLLPLLSYKICSGASPWQTMTTGSHIRGEDNNEVFLISPDRTFSCGFHELGTNALTFSIWYTTTTTNRTVVWTANSYSAESGYSPVNKHGSRISLNHEGNLILTDTNGSTVWESRTSSGKHTKVALLNSGNLVINDSSNNIVWQSFHSPTDTLLPGQNLTKDTRLVSGYHHLYFDNDNVLRMLYDGPEITSIYWPSPDYNAEKNGRNRFNSTRIAVLDDMGNFVSSDGFKIEASDSGPGIKRRITIDYDGNFRMYSLNASTWKWSVTGQAVIQMCYVHGLCGKNGLCDYTNRLQCRCPPDYEMVDPTNWNKGCRPMFSTDKNQSPDDFTFVKQPHADYYGFDLSSNKSISFEACWNICLNTSTCLSFTYKGGDGWCYTKDLLYNGQVYVYFPGDNYMKVPKNSSSLISTISKKESLTCGPPGSEVMLGSASMYGTKKDNINWTYFYVFAAILGALELLVIVTGWYLFFKKHNIPKSMEDGYKMITNQFRRFTYRELREATGKFKEELGRGGAGIVYRGVLEDKKIVAVKKLTDVRQGEEEFWAEVTLIGRINHINLVRMWGFCSEGPNRLLVYEYVENESLDKYLFGERSTESLLGWSQRFRIALGTARGLAYLHHECLEWVVHCDVKPENILLTRDFDAKIADFGLAKLAKRDSTSFNFTHMRGTMGYMAPEWALNLPINAKVDVYSYGVVLLEIVTGIRVSSGILLEERQIDFLEFVQEAKHILSTGNVGDIVDDRLHGHFDTEQAIAMVKIAFSCLEERSKRPTMDEIVKVLMSCDDEDDYHPAYSY

SEQ ID NO: 4064 - protein, 797 aa, Setaria italica
MATLLYLLVLPLLSFQICSGASPWQTMTTGSHIRGEDHDKVFLISSDRTFSCGFHELGTNALTFSIWYTTSTTDRTVVWTANPYSAESGYSPVNKYGSRISLNHDGNLILTDTNGSRVWESRTSSGKHTTITLLNNGNLVINDSDNKIVWQSFHSPTDTLLPGQTLTKDTRLVSGYHHLYFDNDNVLRMLYDGTEITSIYWPSPDYNAENNGRNRFNSTRIAVLDDVGNFVSSDGFKIEASDSGPGIKRRITINYDGNFRMYSLNASTGKWNVTGQAVIQMCYVHGLCGKNGLCDYSGGLRCRCPPDYEMVDPTNWNKGCRPMFSIDKSRATEDFTFVKQPHGDYYGFDLSSNKSISFEACWNICLNTSTCLSFTYKGGDGWCYTKDVLYNGQVYTYFPGDNYMKIPKSSNSLIPYISKQESLTCGPPGSEIMLGSASMYGTKKDNINWTYFYVFAAILGALELLVIVTGWYLFFKKHNIPKSMEDGYKMITNQFRRFTYRELREATGKFKEEIGRGGAGIVYRGVLEDKKIVAVKRLTNVRQGEEEFWAEVTLIGRINHINLVRMWGFCSEGTNRLLVYEYVENESLDKYLFGERSTESLLGWSQRYRIALGTARGLAYLHHECLEWIVHCDVKPENILLTRDFDAKIADFGLAKLAKRDSTSFNFTHMRGTMGYMAPEWALNLPLNAKVDVYSYGVVLLEILTGIRVSNGIMLKERQIDFLEFVQEAKHILSSGNVSDIVDDRLHGHFDTEQAIAMVKIAFSCLEERSKRPTMDEIVKVLMSCDDEDDYHPAYSY

SEQ ID NO: 4065 - protein, 795 aa, Panicum virgatum
MTALLYLLLIPLLSKICSGASPWQTMTTGSHIRGEDHNEVFLISPDRTFSCGFHELGTNALTFSIWYTTSTTNRTVVWTANPYFAASGYSPVNKYGSRISLNHDGNLILTETNGSTVWESRTSSGKHTTVVLLNNGNLVINDSSNNIVWQSFHSPTDTLLPGQNLTKGTRLVSGYHHLYFDNDNILRMLYDGPEITSIYWPSPDYNAEKNGRSRFNSTRTAVLDDMGNFVSSDGFKIEASDSGPGIKRRITIDYDGNFRMYSLNASTGKWNVTGQAVTQMCYVHGLCGKNGLCDYSSGLQCRCPPDYEMVDPTNWNQGCQPMFLTDKNQSPEDFTFVKQPHADYYGFDLSSNKSISFEACRNICLNISTCLSFTYKAGDGWCYTKDLLYNGQVYMYFPGDNYMKVPKNSNSSLSPISKKESLTCGPPGSEVKRGSASMYGTKKDNINWTYFYVFAAILGALELLVIVTGWYLFFKKHNIPKSMEDGYKMITNQFRRFTYRELREATGKFKEELGRGGAGIVYRGVLEDKKIVAVKKLTDVRQGEEEFWAEVTLIGRINHINLVRMWGFCSEGPNRLLVYEYVENESLDKYLFGERSTESLFGWSQRYRIALGTARGLAYLHHECLEWVVHCDVKPENILLTRDFDAKIADFGLAKLAKRDGTSFNFTHMRGTMGYMAPEWALNLPINAKVDVYSYGVVLLEIVTGIRVSSGILLEERQIDFLEFVQEAKHILSSGNVSDIVDDRLHGHFDTEQAIAMVKIAFSCLEERSKRPTMDEIVKVLMSCDDDDYRPAYSY

SEQ ID NO: 4066 - protein, 811 aa, Zea mays
MAALLYLHPYLAVLPLLISPICSGASPWRTMTTGSHMRGEDHDKVTLLSPDATFSCGFHEVGTNALTFSIWYTPSASASATERTVVWTANPYSAERGQHSPVNKYGSRLSLNRDGNLVLTDTNGSTVWETKTSSGRHTTAALLDSGNLVIRDSSSGSNKVVWQSFRSPTDTLLPGQELTKDTRLVSGYHHLYFDNDNVLRMLYDGPEITSIYWPSPDYNALKNGRNRFNSTRVAVLDDLGTFVSSDGFRIEASDSGPGVKRRITIGYDGNFRMYSLNASTGAWRVTGQAVIQMCYVHGLCGRNGLCDYLGGLRCRCPPDYEMVDPTNWNRGCKPMFLTTDDGKEFTFVEQPHADYYGFDLSSNESVPFEACRDMCLNSSACLSFTYKGGDGWCYTKGLLYNGQVFPYFPGDSYMKVPKSFNSSAAYSSISNQKEALTCGPAGSAELMLGPASMYGTKKDNINWTYLYVFAAVLGALEMLVIATGWYLFFNKHSIPKSMEDGYKLVTNPFRRFTYRELAEATGKFKEELGRGGAGVVYRGVLEDKKVVAVKKLTDVRQGEEEFWAEVTLIGRINHINLVRMWGFCSEGTKRLLVYEYVENESLDKYLFGERSAESLLGWSQRYKIALGTARGLAYLHHECLEWVVHCDVKPENILLTRDFDAKIADFGLAKLAKQGSTSLNFTHMRGTMGYMAPEWALNSPISAKVDVYSYGVVLLEIVTGIRASSGIVLDERQIDFRQFVQEAKHILSTGSVSDIVDDRLQGHFHADQAVAMVKIAFSCLEERRKRPTMDEIVKVLMSCGDDDDYHPAYSY

SEQ ID NO: 4067 - protein, 797 aa, Oryza sativa
MAALLYLTILSSLSFHLCSCASPWRTMTTGSHIRAEDHDKIFLLSPDTTFSCGFHQLGTNAFTFSIWYTHTTEKTAVWTANPYSPANGGYSPVNLYGSRVSLGHDGNLVLTDTNGTTVWESKTSSGKHTTVTLLDTGNLVIKDSSNSTVWQSFDSPTDTLLPWQNLTKNIRLVSRYHHLYFDNDNVLRLLYDGPEITSIYWPSPDYNAEKNGRTRFNSTRIAFLDDEGNFVSSDGFKIEATDSGPRIKRRITIDYDGNFRMYSLNESTGNWTITGQAVIQMCYVHGLCGKNGICDYSGGLRCRCPPEYVMVDPTDWNKGCEPTFTIDSKRPHEDFMFVKQPHADFYGFDLGSNKSISFEACQNICLNSSSCLSFTYKGGDGLCYTKGLLYNGQVYPYFPGDNYMKVPKNSSKSTPSISKQQRLTCNLSAPEIMLGSASMYGTKKDNIKWAYFYVFAAILGGLESLVIVTGWYLFFKKHNIPKSMEDGYKMITNQFRRFTYRELKEATGKFKEELGRGGAGIVYRGVLEDKKIVAVKKLTDVRQGEEEFWAEVTLIGRINHINLVRMWGFCSEGTNRLLVYEYVENESLDKYLFGERCHESLLSWSQRYRIALGTARGLAYLHHECLEWVVHCDVKPENILLSRDFDAKIADFGLAKLAKRDSTSFNFTHMRGTMGYMAPEWALNLPINAKVDVYSYGVVLLEIVTGIRVSSGIVVDERQVEFPEFVQEAKKIQATGNVTDLVDDRLHGHFDPEQVITMVKVALSCLEERSKRPTMDEILKALMLCDDEDDYHPAYSY

SEQ ID NO: 4068 - protein, 74 aa, Oryza sativa
MFLVRFCHGSKVSVGESKLCHTVLLLESLITRLPVSRRVTVVCLPEDVLLSHTVVPLVSVRTRLPSWPSDTLEP

SEQ ID NO: 4069 - protein, 237 aa, Triticum aestivum
MAALLFLALLSSLSFHLCSCASASPWHTMTTGSYMRPEDHDRIFLLSPDTTFSCGFHPVGTNAFTFSIWYTTVKTVVWTANPYSAANGYYSPVNLHGSRISLNQDGNLVLADTNGSMVWESKTSSGKHTIVSLLDTGNLVINDSSNKIVWQSFDSPTDTLLPWQKLKKDIRLVSGYHHLYFDNDNVLRLLYDGPDITSIYWPSPDYDAQKMDAIDITAPGSHFWTTRVILCQVMGLK

SEQ ID NO: 4070 - protein, 794 aa, Brachypodium distachyon
MAALLFLALLSSLSFQFCSCASPWQTMTTGSHIRAEDHDRIFLLSSDTTFSCGFHQVGANAFTFSIWYTAVKTVVWTANPYSAVNGYYSPVNLYGSRISLNQDGNLVLTDTNGSTVWESKTSSGKPTTVSLLDTGNLVIKDFGNNIVWQSFHSPTDTLLPWQNLKKDTRLVSGYHHLYFDNDNVLRLLYDGPEITSIYWPSPDYNALTNGRNRYNSTRVAFLDDRGNFVSSDGFKIEASDSGPGIKRRITMDYDGNFRLYSLNASTGNWVVTGQAVIQMCYVHGLCGKNGLCDYSEGLKCRCPPEHVMVDPTDWKKGCKTTFTFGSNQPYQDFTFVKQPHADFYGFDLGSNQSISFQACWNICLNSRSCISFTYKGGDGWCYTKDLLYNGQVYPYFSGDNYMKVPNSFNSSASIPKQESLTCRPNGSDIMLGSATMYGLKKDNIKWIYFYVFTAILGSLELLVIVTGWYLFFKKNNMPKSMEDGYRMITNQFRRFSYRELREATGKFKEEIGRGGAGIVYRGVLEDKKIVAIKKLTNVHQGEEEFWAEVTLIGRVNHINLVRMRGFCSEGTHRLLVYEYVENESLDKYLFGERSAESLLSWSQRYKIALGTARGLAYLHHECLEWIVHCDVKPENILLTRDFNAKIADFGLAKLAKRDNTSFNFTHMRGTMGYMAPEWALNMPINAKVDVYSYGVVLLEIVTGTRVSSGVIFNGRQVEFPEFIQEAKQILATESITDLVDARLHGQFDPEQAIAMVTIAVSCLGDRSKRPTMDEIFKALRSYDGEEEDHPAYSY

SEQ ID NO: 4071 - protein, 601 aa, Zea mays
MSATIDRLATPSHEGRAHSDEKRECNSDEENSEGERKPKKDSFKKRAVTTGYRFRHSLRRKSKTKNDNHIASIEDIRDVQELEIVERFRQCLLDDGLLPEHHDDYHTMLRFLKARKFNIDKAKHMWSEMLRWRKEFGADNIEEFDYTELDEVVKYYPQFYHGVDKDGRPVYIELIGKVDTNKLVQITTIDRYLKYHVKEFERCLQMRFPACSIAAKRHIDSSTTILDVKGVSLKNFTKDARELIMRLQKINNDNYPETLYQLYIINAGQGFKILWGTIKSFLDPETASKIHVLGNKYQTKLLEIIDGSELPEFLGGKCRCEEYGGCPKSDKGPWKDPEIFKRVINGEANYGRQVLAVSSINQKEVGCTEHTTEQEKGNDASAKSISQVEDVSSSTALVDPIISPNLTHLKFQGHASSSDAPPIIGDSIPAAGKVMDACSNPRNSSTPSSSGSFSLRNIPATLGGLKTRIVAWSTFVILTLSAFLCSVLSIVTKRLSNQAITCDHYSADFHQGYMGNGTLTSVLTRLGELEEKVQALEAKPPQVPFEKEELLHTAVYRVDVLEAELISMKKALYETLIRQDELLAYIDQQQTAKFCRQKFCF

SEQ ID NO: 4072 - protein, 100 aa, Zea mays
MAAAASAARSFLRSSGSSSLRSAVARAASRAGPGPAPLPRRMPTSAPRVLLRSPVEMSSVCLESLMPMHSATASALMTSLLAAPACKGFGWLSEGQAETR

SEQ ID NO: 4073 - protein, 93 aa, Saccharum officinarum
MAAAARSFLRSSGSSGLRSAAARAASRAGPAPLPRRMPTSAPRALLRSPVEMSSVCLESLMPMHSATASALMTSLLAAPACKGFGWLSEGQDR

SEQ ID NO: 4074 - protein, 97 aa, Panicum virgatum
MAAAAAARSFLRSSAPSSLRSAAVRAASRAGPAPLPRRMPTSAPRVLLRSPVEMSSVCLESLMPMHSATASALMTSLLAAPACKGFGWLSKGQDETR

SEQ ID NO: 4075 - protein, 97 aa, Setaria italica
MAAAAAARSFLRSSAPSSLRSAAARAASRAGPAPLPRRMPASAPRVLLRSPVEMSSVCLESLMPMHSATASALMTSLLAAPACKGFGWLSEGQGETR

SEQ ID NO: 4076 - protein, 116 aa, Panicum virgatum
  misc_feature (108)..(108): Xaa can be any naturally occurring amino acid
SLSAPARPPPQGRTRTRRRNGARRREVLLRSSAPSSLRSAAVRAASRAGPAPLPRRMPTSAPRVLLRSPVEMSSVCLESLMPMHSATASALMTSLLAAPACKGFGWLXTEAGNDDV

SEQ ID NO: 4077 - protein, 97 aa, Pennisetum glaucum
MAAAAAARSFLRPSAYSSLRSAASRAASRAGPAPLPRRMPAAAPRVLLRSPLEMSSVCLESLMPMHSATASALMTSLLAAPACKGLGWLSEGNSMPL

SEQ ID NO: 4078 - protein, 99 aa, Brachypodium distachyon
MAAAAAARSFLRSAPATSSSLRGSAARAASRACPPPLPRRFPASAPRVLLRSPVEMTSFCVESLMPMHSATASALMTSLLAAPARTGFGWLSEAGNDDV

SEQ ID NO: 4079 - protein, 127 aa, Oryza sativa
MRPHLSTASLIDPLNISIFALRIITVLSAFIRSTIVPCSLRAVNRMQPVSSPMRHSAILVGRAAGPAPAAARPFWTTVLELSTLATSVWPPVPGLSWSTLTNTGFLFAAAAAAAMGTEKRTLESSNG

SEQ ID NO: 4080 - protein, 88 aa, Zea mays
MAAVARSFLRSSGSSSLRSAAARAASRAGPVPLPRRIPSSGPRVLLSVCLESLMPMHSATASALMTSLLAAPACKGLGWLSEAGNDDL

SEQ ID NO: 4081 - protein, 98 aa, Brachypodium distachyon
MAAAAARSFLRSAPAASSSLRGSAARAASRACPPPLPRRFPASAPRVLLRSPVEMTSFCVESLMPMHSATASALMTSLLAAPARTGFGWLSEAGNDDV

SEQ ID NO: 4082 - protein, 397 aa, Panicum virgatum
MGCCGDFFEKAKPYIAMISLQFGYAGMNVITKVSLNHGMSHYVLVVYRHAFATVSIAPFALILERKVRPKMTWPVFLQIFVLALLGPVIDQNFYYAGLKFTGPTFACAMSNILPAMTFVMAVIFRMEKVDLKKVRCQAKVAGTLVTVAGAMMMTLYKGPLMKMAWSSSHAQAHGHAAEAPVAAIDPSGREWFLGSLFVIIATLAWASLFILQAHTLKHYAAPLSLTTLICFVGTLQAIVVTFAMEHRPSVWTIGFDMNLLAAAYAGIVTSSIAYYVQGLVIQKTGPVFASAFSPLMMIIVAVMGSFILAEKIFLGGVLGAVLIVMGLYSVLWGKHKETQEKEEQEAMELPVASSKAVGIYDDATFIKEIAASVGDDSECKKANGVKSSSDGHGAGAV

SEQ ID NO: 4083 - protein, 398 aa, Setaria italica
MGCCGDFFEKAKPYIAMISLQFGYAGMNVITKVSLNHGMSHYVLVVYRHAFATVSIAPFALILERKVRPKMTWSVFLQIFVLALLGPVIDQNFYYAGLKFTGPTFACAMSNILPAMTFVMAVIFRMEKVDLKKVRCQAKVAGTLVTVAGAMMMTLYKGPLMKMAGSSHVQPHGHGGAEAPIAAIDPSGREWFLGSLFVIIATLAWASLFILQAHTLKQYAAPLSLTTLICFVGTLQAIVVTFAMEHRPSVWTIGFDMNLLAAAYAGIVTSSIAYYVQGLVIQKTGPVFASAFSPLMMIIVAVMGSFILSEKIFLGGVLGAVLIVMGLYSVLWGKHKETQEKEEEEAMELPVASKANGVYDDATFIKEIAAAAVVGDDSECKKVNGVKSSSDGHGAGAV

SEQ ID NO: 4084 - protein, 398 aa, Panicum virgatum
MGCYGDFFEKAKPYIAMISLQFGYAGMNVITKVSLNHGMSHYVLVVYRHAFATVSIAPFALLLERKVRPKMTWPVFLQIFVLALLGPVIDQNFYYAGLKFTGPTFACAMSNILPAMTFVMAVIFRMEKVDLKKVRCQAKVAGTLVTVAGAMMMTLYKGPLMKMAWSSHVQAHGHGAEAPVADIDPSGREWFLGSLFVIIATLAWASLFILQAHTLKQYAAPLSLTTLICFVGTLQAIVVTFAMEHRPSVWTIGFDMNLLAAAYAGIVTSSIAYYVQGLVIQKTGPVFASAFSPLMMIIVAVMGSFILSEKIFLGGVLGAVLIVMGLYSVLWGKHKETQEKEEQESMELPVASSKTIGIYDDATFIKEIAAAAVVGDDSECKKANGVKSSSDGHGAGAV

SEQ ID NO: 4085 - protein, 398 aa, Pennisetum glaucum
MGCCGDFFEKAKPYIAMISLQFGYAGMNVITKVSLNHGMSHYVLVVYRHAFATVSIAPFALMLERKVRPKMTWSVFLQIFVLALLGPVIDQNFYYAGLKFTGPTFACAMSNILPAMTFVMAVIFRMEKVDLKKVRCQAKVAGTLVTVAGAMMMTLYKGPLMKMAWSSRSSHVHGGAEAPVAAIVDPSGREWFLGSLFVIIATLAWASLFILQAHTLKQYAAPLSLTTLICFVGTLQAIVVTFAMEHRPSVWTIGFDMNLLAAAYAGIVTSSIAYYVQGLVIQKTGPVFASAFSPLMMIVVAVMGSFILSEKIFLGGVLGAVLIVMGLYSVLWGKHKESQEEEEEAMELPVASKANGGVYDDATFIKEITAAVGDDSECNTKVVNGVKSSSDGHGAGAV

SEQ ID NO: 4086 - protein, 413 aa, Zea mays
MAMGCCYGDFFDKAKPYLAMISLQFGYAGMNVITKVSLNHGMSHYVLVVYRHAFATVSIAPFALILERKVRPNMTWSVFLQIFVLALLGPVIDQNFYYAGLKFTGPTFACAMSNILPAMTFVMAVIFRMEKVDLKKVRCQAKVAGTLVTVAGAMMMTLYKGPLMKMAWTSSGHAHGGGGGAEAAVIDPSGREWFLGSLFVIVATLAWASLFILQAHTLKQYAAPLSLTTLICFVGTLQAIVVTFAMEHRPSVWTIGFDMNLLAAAYAGIVTSSIAYYVQGLVIQKTGPVFASAFSPLMMIIVAVMGSFILAEKIFLGGVLGAVLIVIGLYSVLWGKHKETQDKEDDETTELPVVAIMASKTNGVVYDDDDDVVFVKEIAAAGAGAVGGDDSECRKATGVVKSSSRGHGAAGAV

SEQ ID NO: 4087 - protein, 398 aa, Oryza sativa
MASSPCGGFLEKAKPYFAMICLQFGYAGMNVITKVSLNHGMSHYVLVVYRHAFATISIAPFALLLERKVRPKMTWSVFLQIFVLALLGPVIDQNFYYAGLKFTGPTFACAMSNILPAMTFVMAVIFRMEKVDLKKVRCQAKVAGTLVTVAGAMMMTLYKGPLMQMAWTSHVQAPHGHGAEAPAAAAAVDPSGREWFLGSLFVIIATLAWASLFILQAHTLKKYSAPLSLTTLICFVGTLQAIVVTFAMEHRPSVWAIGFDMNLLAAAYAGIVTSSIAYYVQGLVIQKTGPVFASAFSPLMMIIVAGMGSFILAEKIYLGGVLGAVLIVVGLYSVLWGKHKETQEQDAAMMELPVASKGNDAEFTAATVVGDDDDAADCKKANGVKKSSSSNEQGASAV

SEQ ID NO: 4088 - protein, 392 aa, Brachypodium distachyon
MGCYGDFFEKAKPYIAMICLQFGYAGMNVITKVSLNHGMSHYVLVVYRHAFATVSIAPFALLLERKVRPKMTWSSFLQIFVLALLGPVIDQNFYYAGLKFTGPTFACAMSNILPAMTFVMAVIFRMEKVDIRKVRCQAKVAGTVVTVAGAMLMTLYKGPLMQMVWTSHAQPHGNGGGEGGPVAAAVDPTGREWFLGSLFVIIATLAWASLFILQAHTLKQYSAPLSLTTLICFVGTLQAIVVTFAMEHRPSVWTIGFDMNLLAAAYAGIVTSSIAYYVQGLVIQKTGPVFASAFSPLMMIVVAVMGSFILAEKIYLGGVLGSVLIVIGLYSVLWGKHKETQEESRALAMELPMAVAASKLGDADAAFAKDSECGKADGAKASSNGHGGASAV

SEQ ID NO: 4089 - protein, 382 aa, Triticum aestivum
MGGYGDLFEKAKPYIAMICLQFGYAGMNVITKVSLNGGMSHYVLVVYRHAFATVSIAPFALIFERKVRPKMTWSSFLQIFVLALLGPVIDQNFYYVGLKYTGPTFACAMSNILPAMTFVMAFIFRMEKVDLRKVRCQAKVAGTVVTVAGAMLMTLYKGPLMRMAWTSHGQAHGGEAPAVDPTGREWFLGSLFIIIATLAWASLFILQAHTLKQYSAPLSLTTLICFVGTLQAIVVTLAMEHRPSVWTIGFDMNLLAAAYAGIVTSSIAYYVQGLVIQKTGPVFASAFSPLMMIVVAVMGSFILSEKIYLGGVLGSVLIVIGLYSVLWGKHKETQAESAALREAMASINSKGDGDAVHGHDPECEKANGAPKPSSNGHGASAV

SEQ ID NO: 4090 - protein, 387 aa, Triticum aestivum
MGGYGDLFEKAKPYIAMICLQFGYAGMNVITKVSLNGGMSHYVLVVYRHAFATVSIAPFALIFERKVRPKMTWSSFLQIFVLALLGPVIDQNFYYVGLKYTGPTFACAMSNILPAMTFVMAFIFRMEKVDLRKVRCQAKVAGTVVTVAGAMLMTLYKGPLIRMAWTSHGQPHGGEDPAVDPTGREWFLGSLFIIIATLAWASLFILQAHTLKQYSAPLSLTTLICFVGTLQAIVVTLAMEHRPSVWTIGFDMNLLAAAYAGIVTSSIAYYVQGLVIQKTGPVFASAFSPLMMIVVAVMGSFILSEKIYLGGVLGSVLIVIGLYSVLWGKHKETQAESAALREALPMAMASYTSKVTGDAASAGHDPECEKANGAAKPSSNGHGASAV

SEQ ID NO: 4091 - protein, 387 aa, Hordeum vulgare
MGGYGDLFEKAKPYIAMICLQFGYAGMNVITKVSLNGGMSHYVLVVYRHVFATVSIAPFALILERKVRPKMTWSSFLQIFVLALLGPVIDQNFYYVGLKYTGPTFACAMSNILPAMTFVMAFIFRMEKVDLRKVRCQAKVAGTVVTVAGAMLMTLYKGPLMRMAWTNHGQANGGEAPAIDPTGREWFLGSLFIIIATLAWASLFILQAHTLKQYSAPLSLTTLICFVGTLQAIVVTFAMEHRPSVWTIGFDMNLLAAAYAGIVTSSIAYYVQGLVIQKTGPVFASAFSPLMMIVVAVMGSFILSEKIYLGGILGSVLIVIGLYSVLWGKHKETQAESAALREALPMAMASSNSKGEGDAVQGHDPECSEKANGAAKPSSNGHGASAV

SEQ ID NO: 4092 - protein, 515 aa, Saccharum officinarum
MGEDLVTTLSMENGGGGGHGPCTLLSMDPSGHLSAPDDRAVGVMVQALIGGGAGIGARAHAVSPSGAPPPDINQPWQTDLCDMLDVGLGPQVYSAEAVLSCAPKAGSRKAAKRGDTIWGAWFFFTFYFKPLLSDKCKDKVVRDNSGVSGFDKSDLRLDMFLVQHDMENMYMWVFKERPENALGKMQLRSYMNGHSRPGEPQFPFSVDRGFVRSHRMQRKHYRGLSNPQCIHGIEVVRSPKLAGLTEADLRRWAELTGRELNFIIPQEASDFGTWRTIPNSELELEKPHPVMKSNGTQNPKKAGLNLSSPSNHSGEDGMDLSPVSSKRRKELSPQAMDEEVFFPLNSFPQKTQQDVEMHSPAQPAWLHEFAGVMRNACGPVTAAKSIYEDDQGYLIMVSLPFVDQQRVKVSWRNTLTHGIVKIVCVSTARMQHIRRHGRMFTLADPSPEHCPPGDFIREIPLATRIPEDAKLEACFDEAASVLEIMVPKRGNEPEEHEVRVSLRPPHFGANDLLLT

SEQ ID NO: 4093 - protein, 520 aa, Zea mays
MGEDLVTTLSMENGGGGGGGHHGPCTLLSMDPSGHLSAPDDRAVGVMVQTLIGGGVGAGARAHAVSPSGAPPPDINQPWQTDLCDMLDVGLGPQVYSAEAVLSCAPKAGSRKAAKRGDSIWGAWFFFTFYFKPLLSDKCKDKVVRDNSGGVSGFDKSDLRLDMFLVQHDMENMYMWVFKERPENALGKMQLRSYMNGHSRPGEPQFPFSVDRGFVRSHRMQRKHYRGLSNPQCIHGIEVVRSPNLVGLTEADLRRWADLTGRELNFIIPQEASDFGTWRTIPNSELELEKPHPVMKSNGTQNPKKTGLNLSSPSNHSGEDGMDLSPVSSKRRKELSPQAMDEEVFFPLNSCPQKTQQDVEMHSPTQPAAWLHEFTGVMRNACGPVTAAKSIYEDDQGYLIMVSLPFVDQQRVKVSWRNTLTHGIVKIVCVSTARMQHIRRHGRMFALADPSPEHCPPGDFIREIPLATRIPEDAKLEACFDEAASVLEIMVPKRGNEPEEHEVRVSLRPPHYGANDLLLT

SEQ ID NO: 4094 - protein, 517 aa, Setaria italica
MGEDLVTTLSMENGVGGGHHGPCTLLSMDPSGHLAAPDDRAVGVMVQALIGGAGGVGARAHAVSPSGAPPPDINQPWQTDLCDMLGVGLGHQVYSAEAVLSCVAPKAGSRKAAKRGDSIWGAWFFFTFYFKPLLSDKCKDKVVRDTSGVSGFDKSDLRLDMFLVQHDMENMYMWVFKERPENALGKMQLRSYMNGHSRPGEPQFPFSVDRGFVRSHRMQRKHYRGLSNPQCIHGIEVVRSPNLAGLTEADLRRWAELTGREVNFMIPQEASDFGTWRTIPNSELELERPHPVMKSNGTQNPKKSGLNLSSPSNHSGEDGMDLSPVSSKRRKELSPQAMDEEVFLLVNSCNQKTQQDVEMHSAVQPSWLHGFAGVMRNARGPVTAAKSIYEDEQGYLIMVSLPFVDQQRVKVSWRNTLTQGIVKIVCVSTARMQQIRRHGRIFKLSDPSPEHCPPGDFIREIPLATRIPEDAKLEAYFDEAASVLEIMVPKRGNEPEEHEVRVSLRPPHFGANDLLLT

SEQ ID NO: 4095 - protein, 517 aa, Panicum virgatum
MGEDLVTTLSMENGVGGGHHGPCTLLSMDPSGHLAAPDDRAVGVMVQALIGGGAAVGGRAHAVSPSGAPPPDINQPWQTDLCDMLDVSLGPQLYSAEAMLSCVAPKAGSRKAAKRGDSIWGAWFFFTFYFKPLLSDKCKDRVVRDANGVTGFDKSDLRLDMFLVQHDMENMYMWVFKERPENALGKMQLRSYMNGHSRPGEPQFPFSVDRGFVRSHRMQRKHYRGLSNPQCIHGIEVVRSPNLAGLTEADLRRWAELTGRELNFIIPQEASDFGTWRTMPNSELELERPHPVVKSNGTQNPKKSSLNLSSPSNHSGEDGMDLSPVSSKRRKELSPQAMDEEVFLPVNSCNQKTQQDVEMHSAVQPSWLHEFAGVMRTACGPVTAAKSIYEDEQGYLIMVSLPFVDQQRVKVSWRNTLTRGIVKIACVSTARMQHIRRHGRIFKLADPSPEHCPPGDFIREIPLASRIPEDAKLEAYFDEAASVLEIMVPKRGNEPEEHEVRVSLRPPHFGANELLLT

SEQ ID NO: 4096 - protein, 517 aa, Panicum virgatum
MGEDLVTTLSMENGVGGGHHGPCTLLSMDPSGHLAAPDDRAVGVMVQALIGGGAAAAGRAHAVSPSGAPPPDINQPWQTDLCGMLNVGLGPQLYSAEAMLGCVAPKAGSRKAAKRGDSIWGAWFFFTFYFKPLLSDKCKDKVVGDTNGVSGFDKSDLRLDMFLVQHDMENMYMWVFKERPENALGKMQLRSYMNGHSRPGEPQFPFSVDRGFVRSHRMQRKHYRGLSNPQCIHGIEVVRSPNLAGLTEADLRRWAELTGRELNFIIPQEASDFGTWRTMPNSELELERPHPVVKSNGTQNPKKSGLNLSSPSNQSGEDGMDLSPVSSKRRKELSPQAMDEEVFLPVNSCNQKTQQDVEMHSAVQPSWLHEFAGVMRTACGPVTAAKSIYEDEQGYLIMVSLPFVDQQRVKVSWRNTLTCSIVKIACVSTARMQNIRRHGRIFKLADPSPEHCPPGDFIREIPLASRIPEDAKLEAYFDEAASVLEIMVPKRGNEPEEHEVRVSLRPPHFGANELLLT

SEQ ID NO: 4097 - protein, 481 aa, Pennisetum glaucum
APDDRAVGVMVQALIGGAAGVGARAHAVSPSGAPPPDINQPWQTDLCDMLGVGLGHQVYSAEAMLSCVAPKAGSRKAAKRGDSIWGAWFFFTFYFKPLLSDKCKDKVVRDTSGVSGFDKSDLRLDMFLVQHDMENMYMWVFKERPENALGKMQLRSYMNGHSRPGEPQFPFSVDRGFVRSHRMQRKHYRGLSNPQCIHGIEVVRSPNLAGLTEADLRRWGELTGRELNFMIPQEASDFGTWRTMPNSELELERPHPVIKSNGTQNSKKSGLNLSSPSNHSGEDGMDLSPVSSKRRKELSPQAMDEEVFLPVNSCNQKTQDLEMLSAVQPSWLHGFAGVMRSARGPVTAAKSIYEDEQGYLIMVSLPFVDQQRVKVSWRNTLTQGIVKIVCVSTARMQQIRRHGRIFKLSDPSPEHCPPGDFIREIPLATRIPEDAKLEAYFDEAASVLEIMVPKRGNEPEEHEVRVSLRPPHFGANDLLLT

SEQ ID NO: 4098 - protein, 199 aa, Panicum virgatum
PDDRAVGVMVQALIGGGAAVGGRAHAVSPSGAPPPDINQPWQTDLCDMLDVSLGPQLYSAEAMLSCVAPKAGSRKAAKRGDSIWGAWFFFTFYFKPLLSDKCKDRVVRDANGVTGFDKSDLRLDMFLVQHDMKNMYMWVFKERPENALGKMQLMSYMNGHSRPGEPQFPFSVDRGFVRSHRMQRKHYMGALKPAMYSWD

SEQ ID NO: 4099 - protein, 521 aa, Oryza sativa
MGEDLVTTLSMENGGGGGGGGHHSLCTLLSMDPAGHLDDRAVGVMVQPRIGDGAGRAHAVSLSGAHPPDINQPWQTDLCDMLDVSLGPQIQVYDAEALAVLSSAPKAGNRKAAKRGDSIWGAWFFFTFYFKPLLADKCKGKVTRDANGVSGFDKTDLRLDMFMVQHDMENMYMWVFKERPENALGKMQLRSYMNGHSRPGEPQFPFSVDRGFVRSHRMQRKHYRGLSNPQCIHGIEVVRSPNLASITEVDRRRWVELTGRELNFAIPQEACDFGTWRTMPNTEIELDRPHPVMKGNVHQHPKKLLNGSGLNLSSPSNHSGEDGMDLSPVSSKRRKEVFPHAMDEECFLPLNSCGERTQQDVEMHSVVQPSWQHEFSGVMKKARGPVTAAKSIYEDDQGYLIMVSLPFVDQQKVKVSWRNSLTHGIVKILCVSTAQTPYIRRHDRVFKLADPMPEHCPHGEFVREIPLATRIPEDAKLEAYFDEAAAVLEIMVPKRGNEPEEHEVRVSMRPPHLAANDLLLT

SEQ ID NO: 4100 - protein, 513 aa, Brachypodium distachyon
MGEDLVTTLSMENGGGGGHHGPCTLLSMDPSGHLDDRAVGVMVQPRIGAGARARVVSLSGAAPPDINQPWQTEPCDMLDVGLGPQVYDGEVVLSSAPKAGSRKTAKRGDSIWGAWFFFTFYFKPLLSDKGKGKVVRDSKGLSGFDKSDLRLDMFLVQHDMENMYMWVFKERPDNALGKMQLRSYMNGHSRPGEPHFPFSVDRGFVRSHRMQRKHYRGLSNPQCIHGIEVVNSPNLGGITDLDRRRWVELTGRELNFSIPQEASDFGTWRTMPNSELELERPHPTMKSNVQPPQKKLLNGSSLNLSSPSNHSGEDGMDLSPVSSKRRKEAFPHAMDEDCFLPLNSCNGRTQQDIEMHSVLQPSWLNEFTGVMRKASGPATAAKSIYEDDQGYLIMVSLPFVDQQRVKVSWKNSLTHGIVKILCVSTARMPYLRRHDRVFKLADATPEHCPPGEFIREIPLATRIPEDAKLEAYFDEAAAVLEIMVPKRGSEPEEHEVRVSMRPPHLGTNDLLLT

SEQ ID NO: 4101 - protein, 520 aa, Secale cereale
MGEDLVTTLSMENGGGGGGGHHRLCTLLSMDPSGHLDDRAVGVMVQPRVGARAHAVSLSGAPPPDINQPWQTEPCDMLGVGLGPQVFDAEAVLSTAPKAAAAGSRKNTKRGDSIWGAWFFFTFYFKPLLSDKGKSKVVRDANGVSGFDKSDLRLDMFLVQHDMENMYMWVFKERPDNALGKMQLRSYMNGHSRPGEPHFPFSVDRGFVRSHRMQRKHYRGLSNPQCIHGIEVVSSPNLVGITDVDRRRWAELTGRELNFSIPQEASDFGTWRTMPNSELELERPHTTTMKSNNVVQQQPPKKTLNGSGLNLSSPSNHSGEDGMDLSPVSSKRRKEAFPHAMDEECFLPLNPCTGRTQQDIEMQSVVQPSWLHEFTGVMRKASGPATAAKSIYEDDQGYLIMVSLPFVDQQRVKVSWKNTPTHGIVKIFCVSTARMPYIRRHDRVFKLTDAMPEHCPPGEFIREIPLATRIPEDAKLEACFDEAAAVLEIMVPKRGNEPEEHEVRVSMRPPHLGVNDLLMT

SEQ ID NO: 4102 - protein, 525 aa, Triticum aestivum
MGEDLVTTLSMENGGGGGGHHGLCTLLSMDPSGHLDDRAVGVMVQPRARGGARAHAHAVSLSGAPPPDINQPWQTEPCDMLGVGLGPQVFDAEAVLSAAPKAAAAGSRKTTKRGDSIWGAWFFFTFYFKPLLSDKAKSKVVRDANGVSGFDKSDLRLDMFLVQHDMENMYMWVFKERPDNALGKMQLRSYMNGHSRPGEPHFPFSVDRGFVRSHRMQRKHYRGLSNPQCIHGIEVVSSPNLVGITDVDRRRWAELTGRELNFSIPQEASDFGTWRTMPSSELELERPHTHTAMKSNTNNVQQQPPKKTLNGSGLNLSSPSNHSGEDGMDLSPVSSKRRKEAFPHAMDEECFLPLNPCNGRTQQDVDMQSAVQPSWMHEFTGVMRKASGPATAAKSIYEDDQGYLIMVSLPFVDQQRVKVSWKNTPTHGIVKIFCVSTARMPYIRRHDRVFKLTDAMPEHCPPGEFIREIPLATRIPEDAKLEACFDEAAAVLEIMVPKRGNEPEEHEVRVSMRPPHLGVNDLLMT

SEQ ID NO: 4103 - protein, 520 aa, Hordeum vulgare
MGEDLVTTLSMENGGGGGGGHHGLCTLLSMDPSGHLDDRAVGVMVQPRVGAGARAHAVSLSGAPPPDINQPWQTEPCDMLGVGLGPQVFDAEAVLSTAPKAAAGSRKTTKRGDSIWGAWFFFTFYFKPLLSDKGKSKVVRDANGVSGFDKTDLRLDMFLVQHDMENMYMWVFKERPDNALGKMQLRSYMNGHSRPGEPHFPFSVDRGFVRSHRMQRKHYRGLSNPQCIHGIEVVNSPNLVGITDVDRRRWAELTGRDLNFSIPQEASDFGTWRTMPNSELELERPHTATVKSNNVQQQPPKKMLNGSGLNLSSPSNHSGEDGTDLSPVSSKRRKESFPHAMDEECFLPLNPCTGRTQQDVEMQSVVQPSWLHDFTGVMRKASGPATAAKSIYEDDQGYLIMVTLPFVDQQRVKVSWKNTPTHGIVKIFCVSTARMPYIRRHDRVFKLTDAMPEHCPPGEFIREIPLATRIPEGAKLEAYFDEAAAVLEIMVPKRGNEPEEHEVRVSMRPPHLGVNDLLMT

SEQ ID NO: 4104 - protein, 1501 aa, Sorghum bicolor
MDSSSPFSPDDQTDADFFDKLVDDDDNPIPPPATDLPRSVSATSLDAADDHAPPPATDLPRPVSATSLDATDDPPAPEPQPPAPEGSGKDGAGVHTAVKQVQWASFGGGADDGPDPFADLSGGAGDDDGFLGSTAGTQTASDQDFFAGTNSSSDQQNVNGQHDQGGGTSTAVDSADPKSWEAMYPGWKYDEASQQWYQLDGSVNSTGNAAQVLENSTQNAQQQQLDTSYLHNSSHAGLETIAEEGTAAAGAVSSWGQGAASEYPPNMLFYAEYPGWYFDTNTQQWHSLESYQQAAMQAGTASTGQTVVANDVVAANSSSLTGYNAAQTEDLAAHNQVTQHNSFSNSFTLQNQWQTTDAFGNNVRSESATDNSLASSFYGFEQNRNAETTTSSMSQQAGFNTAETVTDHYGARKGFESSSLRSGYSSSDSQQSSYKAFEPSTGYQTGYKAFEPAMDNQSGYKALPSTGHHNASQGFMPSTGHRTDFKGSGASTVHQAGYKEFETSTGYSTSFKAFEPSSSQHASYKGSQPNYTGFDTSANHHGYGDANGVASTQGFVPMQTTYQGQKQANATSQGHLSNSYFGTESSMNFNQQQFLGANASNLQFGHSPHEGRSSAGRPPHALVAFGFGGKLIILKETSSMPASFNTGNQFKGNSSSTVSVLNLSEVVVDKVDPSSITNGSALSYFHALCRQPVPGPLVGGSAASKDVNKWLDEMIALYESSSSEFQKGDTRKLLISLLKILSQHYGKLRSPFASDPSQEETDGPEMAVTKLFSSCKRSTVHMGDYGSIVPCMKNIASESQMQAVAQEVQGLLVSGRRKEALQCAQRGQLWGPAIILALQLGDQFYVDTVKKMAHFHFVSGSPLRTLCLLIAGQPADVFNVENNVNSDYGTSGQPMESQPGPNGMLDDWEENLAIITANRTKGDDLVITHLGDCLWKEKNEVAAAHSCYLVAELNIDSYSESARLCLIGADHLKCPRTFASPEAIQRTEVYEYAKVLGNSQYILLPFQPYKLIYAYMLVEVGKVSDSLRYCQASMKVLKASGRAPELEVWKQLFSSLEERIRTHQQGGYGTNLAPAKLVGKIFTSLDKSISRMMGTPSAPLPPLPHGSVSDRESHSMPAAAKFGNSQSVMTMSSLMPSASMQSMTEIAENSGGTGRTIAHNRSVSEPDFGRTSKQGAGSDGTQSSASGSGSSRFGWLVQKTMDLVSKSHRQAKLGDQNKFYYDEKLKRWVEEGAAVPAEEPPLPPPPTKPSFQNGMPDHKLNGPMSVNHAPNGVTEWKSSNSSEQGGLGMPPIPPSQNQFSARGRMGVRSRYVDTFNKSGASGAVPSYNKPAAPSVTPPAGAKFFMPTAAPAAADQMVPHQAAEIHSETIHQDERSASPPAETSFSSTPPPTQFSSPPPHMQFSSPMQSTIHRQSSMDNISTPYQGSGVSSLSSSSSFSKSRAASWSGTYSEQYSAFAGTQSPDRQTMPSPLMPGKPSHSRSNSNSSVQLNGLAEDLHEVEL

SEQ ID NO: 4105 - protein, 1478 aa, Zea mays
MASSSFAPDDQTDADFFDKLVDDDDPATDLPRAVSATSVADDPPPVLEPQVPAPAPSEGSGKGGAGVHTAVKQVQWASFGGGVDDGPDPFADLSGGAGDDDGFLGNTAGTQAALDHAAEVTDQDFFAGSSSSDQQNVHGQHDQGRGSAAVDSADPKSLEAMYPGWKYDEASQQWYQLDGSVNSTGNAAQALDDSAQNAHHHQQQLDAAYLHNSAHAGLGTIAEESTTAAGAANSWGQGAAPEYPPSMLFYAEYPGWYFDTNTQQWHSLESYQQAAVQAGTSSTGQTVVASDDVVATSSLTGHNAGQTEDLVAHNQVTQRNSSSNSFTHQNQWQTTDALGNNVQSESLASSFYGFEQHMNAETTSSSTSQQTGFHTAETITDHYGGRKAFESSSLQSGYSSSDSQQSSHKAFEPSTGYQAGYNGFEPASGHHTAFEPAMHNQSGYKAFDPSTGHHSASWGFMPSTGQQTDFKGSRASTVHQAGYEEFEISRGYNTNFKAFESSSSQNAGYNGSQPSSGHQPNYMGFDTSANHHGYTDVNGVASTQGFVPMQTTYQGQKQANATSQGHLSNSYLGTDNSMNFNQQQFLGANASNLQFGHSPHEGRSSAGRPPHALVAFGFGGKLIVMKETTSMPASFNSGNQGNSSSTVSVLNLLEVVFDKVDPSSVTNGSALSYFHALCRQPVPGPLVGGSAASKDVNKWLDEMIARYESSSSEFHRGDTRKLLISLLKILSQHYGKLRSPFASDPSQEETDGPEMAVTKLFSSCKRSTVHMGDYGSLVPCMKSIPSESQMQAVAQEVQSLLVSGRRKEALHCAQAGQLWGPAIILALQLGDKFYVDTVKKMAHFHFVSGSPLRTLCLLIAGQPADVFNVENNVNSDYGASHQPVEPGPNMLDDWEENLAIITANRTEGDVLVITHLGDCLWKEKNEVAAAHSCYLVAELNIDSYSESARLCLIGADHLKCPRTFASPEAIQRTEVYEYAKVLGNSQYILLSFQPYKLIYAYMLVEVGKVSDSLRYCQASIKVLKASGRAPELEVWKQLFSSLEERIRTHQQGGYGTNLAPGKIVGKIFTSLDKSISRMMGTPSAPLPPLPHGSFSDKESHSIPAAAKFVNSQSVMVMPSLIPSASMQSMTEIAEDSGGTGRKIAHNRSVSEPDFGRSSKQGAGGSDGTQSSASGSSSSRFGWLVQKTMGLVSKSHRQAKLGDQNKFYYDEKLKRWVEEGAAVPAEEPPLPPPPTKPSFQNGMLDNKLNGPMSVSHAPNGVTEWKSSNSSEQGLGMPPIPPSQNQFSARGRMGVRSRYVDTFNRSGASGAMPSYNKPAAPSMTPPAGAKFFMPTAAPVAADQMIPHQAAEIHSETIHQDERSASPPAETSFSSTPPPTQFPSPVQSTIYRQSSMENISTPYQGSGVSSLSNDSSFSKSRAASWSGTYSEQFNAFAGTISPDRQTTHSPLMPGKPPHSRSNSNSSGHLNGLAEDLHEVEL

SEQ ID NO: 4106 - protein, 1493 aa, Zea mays
MASSSSFAPDDQTDADFFDKLVDDDDPATSLPDDPPIPEPQAPPEGSGKGGAGVHTAVKQVQWASFGGGADDGPDPFAHLSGGAGDDDGFLVTTAGTQTASDHAFFGGTQSLAAEVTDQDFFAGSNSSNQHNVSGQHDQGGGSTAVDSADPMSLEAMYPGWKYDEASQQWYQLDDSVNSTGNAAQVLDNSTRYAQQQQQLHASYLHNSVHSGLETIAEEGTTATGAVSSWGQGAASEYPPNMLFYAEYPGWYFDTNTQQWHSLELYQQAAMQAGTASMGQTVIANDGVAATSSLTGYNAAQNEDLAAHDQVTQHNSFSNSFAHQNQWQITDAFGNNVRSECATENSLASSSYGFQQHRNADSTSSSTNQRAGFNAAETVTDHYGGRKGVESPSIQSGYSTSDIQQSSHKAFEPYTGYQDHYKAFEPATGHHASNNMFKQSTGNQGGYKAFEPAMDNQSGYKAYEPSMGHHSASWEPVPSTGHQTDFKGSGASTVHQAGYKEFETSTGYNTSLKAFEPSSSQHAGYMGSQSNYMGFDTSTNHHGYGDANVVASTQGFVPMQTTYQGQTQAIANSQVHLSNSYLGIDNSMNFNQQQFLGANASNLQFSHSPHDGRAGRPPHALVSFGFGGKLIVMKEASSMPASFNNGIQGNSSGTVSVLNLSEVVMDKIDSSSITNGSALSYFHALCRQPVPGPLVGGSAASKDVNKWIDEMIAWYDSSSELQRSDTRKLLISLLKILSQHYGKLRSPFASDPSQEETDGPEMAVTKLFSSFKSTVNMGDYGSIVSCMKNIPSESQMQAVAQEVQNLLVSGRRKEALQCAQGGQLWGPAIILALQLGDMFYVDTVKKMAHFHFVSGSPLRTLCLLIAGQPADVFNVDNNVNIDYGTSHQPMEPGPNGMLDDWEENLAIITANRTKGDDLVITHLGDCLWKEKNEIAAAHSCYLVAELNIDSYSESARLCLIGADHLKCPRTFASPEAIQRTEVYEYAKVLGNSQYILLPFQPYKLIYAYMLVEVGKVSDSLRYCQASMKVLKASGRAPELEVWKQLISSLEERIRTHQQGGYGTNLAPAKLVGKIFTSLDKSISRMMGTPSAPLPPLPHGSVSDRESHSMPEAAKFINSQSVMAMSSLMPSASMQSMTEIAENSDGTGRKMAHNRSVSEPDFGRTSKQGGGSDGTQSSAAGSGSSRFGWLVQKTMGLVSKSHRQAKLGDQNKFYYDEKLKRWVEEGAVVPAEEPPLPPPPTKSSFQNGMPDHKLNGHMSVGHAPSGVTEWKSSNYSEQGLGMPPIPPSQNQFSSRGRMGVRSRYVDTFNKSGASGAVPSYNKPAAPSVTPPAGAKFFIPTAAPVAADQMMPHQAAEIHSETMQQDERAASPPAGTSFSSTPPPTQFSSPPPHTQFSSPMQSTIHRQSSMANISTPYQSSGVSSLSSDTSFSKSRAASWSGTYSEQFSAFAGTRSPDGQTVRSPLMPGKPSHSRSNSNSSVQLNGLTEDLHEVEL

SEQ ID NO: 4107 - protein, 640 aa, Setaria italica
MDLHMKLLLASLSCVLLMQAASCDGTTGETVTTNWTCICAAHPLGESNSNSSLLSNCSSSCHCQQDEDGGTGSWNCTCASDKTLLKEEHAVLRDRSCFTSCNCTSGSSEEGKRHVSSKTVIITLLVCVVLTTTAFLVTTVYYFRRKDALSPRSQIYSFDKYTSWSSRSYLVSHRSSPLPQLKPKPRLSVLKEFLCSCPIICGGESGTFPGVIIRFSYAELEEATGKFSEEHLIGVGGSSKVYRGQLSDGKVVAVKKLRPLGGADEDFEFLSEIELLSRLNHCHVVPLLGYCSEIQGRQLERLLVFECMSNGNLRDCLDLKQGRKPMDWQTRVSIALGAARGLEYLHEAAAPRILHRDIKSTNILLDDKFRAKITDLGMAKCLMNDGVTSCSSSPARMLGTFGYFAPEYAIVGKASLKSDVFSFGVVILELITGRPPIHKSSSTRADESLVIWATSRLRDSRLVVAELPDPTLESKFPAEEMQIMAHLARECLQWDPEARPTMTEVVQILSTIAPPLHGAKRRNLPIAAAFNLTPSPHVGRCDPEPVDIEAPQECSTASFRWQQEPCAPPPPGRASWPGDRHKGAASGGAVVSGELVNGMLLMSPHGRSSWRPPPGDEEEEEAVDLTEPRLETFTQPALFR

SEQ ID NO: 4108 - protein, 638 aa, Panicum virgatum
MDLHMKLLLVSLSCVLLMQAASCDGTTGETEMTNWTCVCAAHPLGESNSNSSLLSNCSSSCRCQQDENGGTGSWNCTCASDKTRQKEEHAMLHDRSCFTSCNCTSGSSEEGKRHVSSKTVIITLLVCVVLTTTAFLVTTVYYIRRKDALSPRSQIYSFDKYTSWSSRSNLVSHRSSPLPQLKPKPRLRVLKEFLCSCPIICGSESGTFPGVVIRFSYSELDEATGKFSDEHLIGVGGSSKVYRGQLSDGKVVAVKKLRPLGGADEDFEFLSEIELLSRLNHCHVVPLLGYCSEIQSRQLERLLVFECMSNGNLRDCLDLKQGRKPMDWQTRVSIALGAARGVEYLHEAAAPRILHRDIKSTNILLDDKFRAKITDLGMAKCLMNDGVTSCSSSPARMLGTFGYFAPEYAIVGKASLKSDVFSFGVVILELITGRPPILKSSSTRTDESLVIWATSRLRDSRLVVTELPDPTLQGKFPAEEMQIMAHLARECLQWDPEARPTMTEVVQILSTIAPTLHGTKRRNLPIAAAFNLTPSPHVGRYDPEPADIERQQECSTTSAQWQQGRCAPPPGRASWPGDRNKGAAGGGAVVSGELVNGMLLMMSPHGRSSWRPPPGDDDEEVVDLTEPRLETFTPALFR

SEQ ID NO: 4109 - protein, 664 aa, Zea mays
MKLLLPSFISCLLLMQAALCDGAAATTTTTGENGTANWTCVCAAHPLGEPDSNSSLLSNCSSSCHCHRDENGGGGGGGAGSWNCTCASGDEGLQKEEHAELRDGSCFTSCNCTSGTGTSEEGRKRVSSKTVIATLLVCVVLTTTAFLVTTVYYFRRKDALSPRSQIYSFDRYTTSWSSRSNLVSSRSSPLPQMKPKPKLGGLKEFLCSCNLVICGGESGAFPGVVARFSYAELEQATGRFSDDHLIGVGGSSKVYRGQLGDGRVVAVKKLRPLGGTDEDLEFLSEIELLSRLNHCHVVPLLGYCSESQGRQLERLLVFECMANGNLRDCLDLKRGRKPMDWQTRVSVALGAARGLEYLHEAAAPRILHRDIKSTNILLDDKFRAKITDLGMAKCLMNDGVTSCSSSPARMLGTFGYFAPEYAIVGKASLKSDVFSFGVVVLELITGRQPIHKSSSTRADESLVLWATSRLRDSGLVVTELPDPTLQGKFPAEEMQIMAHLARECLQWDPEARPTMTEVVHILATIAPLQHGAKRRNLPIATAFNLTPSPHVGRCDPEPKDDDIERQMQQQECSPTTAVQWQQQQARCTHAPTGRASWPGDRGNVVSRGAAVSGELVNGTVLMNPHGRGSWRRPPPLGDEEAVDVDLTEPRMEAFTQPAAFQPFR

SEQ ID NO: 4110 - protein, 363 aa, Sorghum bicolor
MADGEGEWSYSKNSRRPEIYFRETKPVVENAIKEVYTTLLPKTMIIGDLACAAGPNTLLFMSSVISTIVEHCKSSRDDSVELQFFLNDLPGNDFNELFRLIEKFRRPNITGERAHLPPFYYIQGLPESYYNRLFPRESVHIFHSSYGLHWRSQELEGLESWRKTYLNEDNIYITKTTTPFVVKQFQKLFYKDFSLFLKLRHEELVHGGQMVLIFNGRKDEDVYNGDLNKLFALVAIALKSLVLKGLVDKEKLQSFNLPVYGPSVGEVKELVMQSHLFNMNLIKQFETNWDPFDDSEGDDVEDNACSSMNIAKFIRPALKSLIVRHFGETIIDAWFTEFKSLVAEHLEKEKTKFTIIVMSLKKE

SEQ ID NO: 4111 - protein, 371 aa, Saccharum officinarum
MGWASCCWSDGAEPGRRKKKKDTTWRIFSLKELQSATNNFNYDNKLGEGGFGSVYWGQLWDGSQIAVKRLKSWSNKAETEFAVEVEILARVRHKSLLSLRGYCAEGQERLIVYDYMPNLSIHSQLHGQHAAECNLSWERRMKIAVDSAEGIAYLHHYATPHIIHRDVKASNVLLDSNFQARVADFGFAKLIPDGATHVTTKVKGTLGYLAPKYAMLGKASESCDVFSFGIMLLELASGKKPVEKLNPTTKKTITEWALPLARDKKFKEIADPKLKDSFIEDELKRMVLVGLACSQDKPEQRPIMSEVVELLKGESTEKLSNLENDDLFKPDSSFQSSSGPDSSDCVTEERSSKADAIEEAVDSSETVPSAR

SEQ ID NO: 4112 - protein, 374 aa, Setaria italica
MGWASCCKRSDGAEPGRKKKKKDTAWRVFSLKELQLATNNFNYDNKLGEGGFGSVYWGQLWDGSQIAVKRLKSWSNKAETEFAVEVKILAQVRHKSLLSLRGYCSEGQERLIVYDYMPNLSIHSQLHGQHAAECNLGWERRMKIAIDSAEGIAYLHHYATPHIIHRDVKASNVLLDSNFQARVADFGFAKLIPDGATHVTTKVKGTLGYLAPEYAMLGKASESCDVFSFGIMLLELASGKKPVEKLNPTTKRTIAEWALPLARDKKFKEIADPKLNGNFIEDELKRMVLVGLACSQNKPEQRPIMSEVVELLKGESAEKLSNLENDELFKPEQTSSFQGSSGPDSSDCITEEKSSKADAIEAAVDSSETVPSAR

SEQ ID NO: 4113 - protein, 370 aa, Zea mays
MRWASCCKLSDGDEPGRRKKDASWRIFSLKELQSATNNFNYDNKVGEGGFGSVYWGQLWDGSQVAVKRLKSWSNKAETEFAVEVEILARVRHKSLLSLRGYCAEGQERLIVYDYMPNLSIHAQLHGQHAAECNLSWERRMKIAVDSAEGIAYLHHHATPHIIHRDVKASNVLLDSNFQARVADFGFAKLVPDGATHVTTRVKGTLGYLAPEYAMLGKASESCDVFSLGVMLLELASGKKPVEKLNPTTKRTIAEWALPLARDRKFKEIADPKLNGSFVEDELKRMVLVGLACSQDKPEQRPVMSEVVELLRGESTERLSRLENGDLFKPDISFHGSSGPDSSDCVTEERSPKADATEEAVDSSETVPSAR

SEQ ID NO: 4114 - protein, 374 aa, Panicum virgatum
MRWASCCKLSDGGEPGRRKKKKGAAWRIFSLKELQLATNNFNYDNKLGEGGFGSVYWGQLWDGSQIAVKRLKSWSNKAEKEFAVEVEILARVRHKSLLSLRGYCAEGQERLIVYDYMPNLSIHSQLHGQHAAECNLGWERRMKIAIDSAEGIAYLHHYATPHIIHRDVKASNVLLDSNFQARVADFGFAKLIPDGATHVTTKVKGTLGYLAPEYAMLGKASESCDVFSFGIMLLELASGKKPVEKVNPTTKRTITEWALPLARDKKFKEIADPKLNGNFIEDELKRLVLVGLACSQNKPEQRPIMSEVVELLKGESAEKLSNLENDELFKPEQTSSFQGSSGPNSSDCITEEKSSKTDVKEEAVDSSETVPSAR

SEQ ID NO: 4115 - protein, 374 aa, Pennisetum glaucum
MGWASCCKRSDGAQPGRRKKKKDTAWRVFSLKELQSATNNFNYDNKLGEGGFGSVYWGQLWDGSQIAVKRLKSWSNKAETEFAVEVEILARVRHKSLLSLRGYCSEGQERLIVYDYMPNLSIHSQLHGQHAAECNLGWERRMKIAIDSAEGIAYLHHYATPHIIHRDVKASNVLLDSNFQARVADFGFAKLIPDGATHVTTKVKGTLGYLAPEYAMLGKANESCDVFSFGIMLLELASGKRPVEKLNPTTKRTIAEWALPLARDKKFMEIADPKFNGNFVEDELKRMVLVGLACSQNKPEQRPIMTEVVELLKGESAEKLLNLENDEMFKPEQTNSFQGSSGPNSSDCITEEKSSKADAIEAAVDSSETIPSAR

SEQ ID NO: 4116 - protein, 374 aa, Panicum virgatum
NSSYSLHCCVLRGEPGRRKKKKGAAWRIFSLKELQLATNNFNYDNKLGEGGFGSVYWGQLWDGSQIAVKRLKSWSNKAEKEFAVEVEILARVRHKSLLSLRGYCAEGQERLIVYDYMPNLSIHSQLHGQHAAECNLGWERRMKIAIDSAEGIAYLHHYATPHIIHRDVKASNVLLDSNFQARVADFGFAKLIPDGATHVTTKVKGTLGYLAPEYAMLGKASESCDVFSFGIMLLELASGKRPVEKVNPTTKRTITEWALPLARDKKFKEIADPKLNGNFIEDELKQVVLVGLACSQNKPEQRPIMSEVVELLKGESAEKLSDLENDELFKPEQTSSFQGSSGPDSSDCITEEKSSKTDVKEEAVDSSETVPSAR

SEQ ID NO: 4117 - protein, 374 aa, Triticum aestivum
MGWLSCCKRSNGAQPGRKKKKKDTTWRIFSLKELQLATNNFNYDNKLGEGGFGSVYWGQLWDGSQIAVKRLKSWSNKAEKEFAVEVEVLARVRHKSLLSLRGYCAEGQERLIVYDYMQNLSLHSHLHGQHAAECHLGWERRMNIAIDSAEGIAYLHHHAIPHIIHRDVKASNVLLDANFQARVADFGFAKLIPDGATHVTTKVKGTLGYLAPEYAMLGKAKESCDVYSFGVLLLELASGKKPVEKINPTTKLTITEWALPLAREQKFKEMADPKLGDSFVEAEVKRMVLVGLACTQTKPEQRPVMSEVVEMLKGESAEKFSILENDDLFKPQPTSSVQGTSGPCSSDAITEEKESKEDTIEEATDSSETVPSAR

SEQ ID NO: 4118 - protein, 374 aa, Secale cereale
MGWLSCCKRSNGAQPGRKKKKKDTTWRIFSLKELQLATNNFNYDNKLGEGGFGSVYWGQLWDGSQIAVKRLKSWSNKAEKEFAVEVEVLARVRHKSLLSLRGYCAEGQERLIVYDYMQNLSLHSHLHGQHAAECHLGWERRMSIAIDSAEGIAYLHHHAIPHIIHRDVKASNVLLDANFQARVADFGFAKLIPDGATHVTTKVKGTLGYLAPEYAMLGKAKESCDVYSFGVLLLELASGKKPVEKINPTTKLTITEWALPLAREQKFKEMADPKLGDSFAEAEVKRMVLVGLACTQTKPEQRPVMSEVVEMLKGESADKFSILENDDLFKPQQTSSVQGTSGPCSSDAITEEKESKEDTIEEATDSSEAVPSAR

SEQ ID NO: 4119 - protein, 374 aa, Leymus cinereus x Leymus triticoides
  misc_feature (2)..(2): Xaa can be any naturally occurring amino acid
  misc_feature (93)..(93): Xaa can be any naturally occurring amino acid
MXWLSCCKRSNGAQPGRKKKKKDTTWRIFSLKELQLATNNFNYDNKLGEGGFGSVYWGQLWDGSQIAVKRLKSWSNKAEKEFAVEVEVLARVXHKSLLSLRGYCAEGQERLIVYDYMQNLSLHSHLHGQHAAECHLGWERRMNIAIDSAEGIAYLHHHAIPHIIHRDVKASNVLLDANFQARVADFGFAKLIPDGATHVTTKVKGTLGYLAPEYAMLGKAKESCDVYSFGVLLLELASGKKPVEKINPTTKLTITEWALPLAREQKFKEMADPKLQDSFAEAEVKRMVLVGLACTQNKPEQRPVMSEVVEMLKGESAEKFSILENDELFKPQQTSSVQGTSGPCSSDAITEEKESKEDTIEEATDSSETVPSAR

SEQ ID NO: 4120 - protein, 369 aa, Brachypodium distachyon
MGWLCCCKRPDGKKKRKDTTWRIFSLKELQSATNNFNYDNKLGEGGFGSVYWGQLWDGSQIAVKRLKSWSNKAEKEFAIEVEVLARVRHKSLLSLRGYCAEGQERLIVYDYMQNLSLHSHLHGQHAAECHLSWERRMNIAIDSAEGIAYLHHHAIPHIIHRDVKASNVLLDANFQARVADFGFAKLIPEGVTHVTTKVKGTLGYLAPEYAMLGKAKESCDVYSFGVLLLELASGKKPVEKINPTTKLTITEWALPLACDKKFKEMADPKLKDSFIEAEVKRMVLVGLACTQKKPEQRPIMSEVVELLKGESAEKLSNLENGELFKPEQASSCQGTSGPNSSDVITEEKDSKEDTIEEATDSSETVPSVR

SEQ ID NO: 4121 - protein, 374 aa, Festuca arundinacea
MRWFSCCKRSDGAQPGRKKKKKDTTWRIFSLKELQSATNNFNYDNKLGEGGFGSVYWGQLWDGSQIAVKRLKSWSNKAEKEFAVEVEVLARVRHKSLLSLRGYCAEGQERLIVYDYMQNLSLHSHLHGQHAAECQLSWERRMNIAIDSAEGIAYLHHHAIPHIIHRDVKASNVLLDANFQARVADFGFAKLIPDGATHVTTKVKGTLGYLAPEYAMLGKAKESCDVYSFGVLLLELASGKRPVEKINPTTKLTITEWALPFARDMKFKEMADPKLSDSFDEAEVKRMVVIGLACTQKTPERRPIMSEVVELLRGESAEKFSELENGDLFKLEQTSSGQRQPGHGISDAISEEKDSKEDAIEEAVESIETVPTAR

SEQ ID NO: 4122 - protein, 377 aa, Zea mays
MGWASCCKRSDGAEPGRRRRKKKDTAWRIFSLKELQSATNNFNYDNKLGEGGFGSVYWGQLWDGSQIAVKRLKSWSNKAETEFAVEVEVLARVRHRSLLSLRGYCAEGQERLIVYDYMPNLSIHSQLHGQHAAECNLSWERRMRIAVDSAEGIAYLHHSATPHIIHRDVKASNVLLDADFQARVADFGFAKLVPDGATHVTTKVKGTLGYLAPEYAMLGKASESCDVFSFGVTLLELASGRRPVEKLSPTAAAKQTVTEWALPLARARRFGEIADPKLGGGFVEEELKRVVLVGLVCAQDRPELRPTMSEVVQLLKGESAEKLDSLENDCLFKPGGGSFQGSDCVGEGEGEGEGRSPGADGGIQEAVDSSETVSSAS

SEQ ID NO: 4123 - protein, 500 aa, Zea mays
MGEEAAAATATATVAAGNAPPHLLLVCFPGQGHVNPMVRLAKRIAAKGPLVTFSSLSSIGAKLTASAGVSAGGDGVPVGRGRVRFEFMDDEDPGPDLDDLMRHIAKDGPPALAELLGRQARAGRPVACVVVNPFMPWAVDVAADAGIPSAVLWVQSCAVFSLYYHHVHGLVEFPPEDDLDARFTLPGLPEMSVADVPSFLLPSNPYKLLVDAIIAQFHNIHRASWVLANSFTELEPDVAAALPGVTPRPPELIPVGPLIEVGGGRDDDEGAVRGDLMKAADGCVEWLDAQAPRSVVYASVGSVVRLNAEEVGEMAHGLASTGRPFLWVVRPDTRPLLPDGFLDSVAGRGAVVPWSPQDRVLAHPSTACFLTHCGWNSTLETIAAGVPVVAFPQWGDQCTDAKFLVDELGMGVRLRGPLRRDAVREAVDAAVAGPEADAMLASARRWSAAAREAVAPGGSSDAHVQAFVDEVSRRACGVQVAKVVPPSSEELHQSPVRVQT

SEQ ID NO: 4124 - protein, 851 aa, Zea mays
MGEEEGAPTVAAAAESAPPHLLLICFPGQGHVNPMLRLAKRIAAKGLLVTFSSISRVGAMLAASVGVSAGGDGVPVGRGRVRFEFMDDEDPGPDLDDLLRHLAKDGPPAFAELLERQADAGRPVACVVVNPFMPWAVDVAADAGIPSAVLWVQSCAVFSLYYHHVHGLVEFPPEDDLDARFTLPGLPEMSVADVPSFLLPSNPYKLLVDAIIAQFHTIDRASWVLVNSFTELEPDVAAALPGVTPRPPELIPVGPLIEVDEQHDGDGDGAGSGAVRGDLMKAADDCVEWLDAQAPRSMVYASVGSVVRLNAEEVGEMAHGLASTGRPFLWVVRPDTRPLLPEGFLDSVAGRGTVVPWSPQDRVLAHPSIACFLTHCGWNSTLETIAAGVPVVAFPQWGDQCTDAKFLVEELRIGVRLRGPLRRDAVREAVDAAVAGPEADAMLANARRWSAAAREAVALGGSSDAHIQAFVDEDVNETREEEARGEDAADYDAADADYEQEDDAGGGGGDGWSSGGGQFEGGWSAGGWDSWPSSDAGASSGGGSSRARKSRKTHWVPPPKVPAREEDKILIVPCGDESWIDASFQGQGRRTQVNKVLGSICKYLWPGVVMEKGVEVPCMSWDQYGLAFNAEHRNAQGAVWHEFWKRYKLPEDGSMNDRARIVFNKSATTLVRDQMYYARIQATSDYILRQEGRRPRSKSEASNKYLTEEEYLEFSDSVPWMASNEAGWRAVCKYWATDGFKGVSMRNSSNRGHDVHHRYGGDGHVRLAKRMEASSGVTPSDVQVYLRGHRGSDPTNPEQLCSQSAAERVVRLSQLVTMHFYSKSREKYNCIIYYLSGLIWCFHDVGAWARL

SEQ ID NO: 4125 - protein, 369 aa, Panicum virgatum
MGEEAAAVPHAVAAASAPPHLVLICFPGQGHVNPMLRLAKRVAAKGLLVTFSSLASVGARLAAAAGVSAGGDGVPVGRGRVRFEFLEDGDPGSHLDDLMRHLETAGPPAFAALLRRQAEEGRPVACVVVNPFMPWASDVAAGEGIPTAVLWVQSCAVFSLYYHQVHGLVEFPPEDDPEARFQLPGLPEMSAADVPSFLLPSNPFKLLADAIITQFRTIERASWVLVNSFAELEPDVVAALPGVTPRPPELISVGPLIELQQQEGQEDDDAVRGDLIKGRRRLRGVAGRAAAAVRGVRVGGQRGGAVPRRGRGDGARAGVNGAAVPVGGAAGTRSRTCPRGSWTPCPGAARWWRGARRSACWRTRRRRAS

SEQ ID NO: 4126 - protein, 497 aa, Panicum virgatum
MGEEAAAVPHAVAAASAPPHLVLICFPGQGHVNPMLRLAKRVAAKGLLVTFSSLASVGARLAAAAGVSAGGDGVPVGRGRVRFEFLEDGDPGPDLDDLMRHLDTAGPPAFAALLRRQAEEGRPVACVVANPFMPWASDVAAGEGILTAVLWVQSCTVFSLYYHHVHGLVEFPPEDDPEARFRLPGLPEMSAADVPSFLLPSNPFKLLADAIITQFRTIGRASWVLVNSFAELEGDVVAALPGVTPRPPELIPVGPLIELQQQAGQEEEDAVRGDLIKAADDCVEWLDAQPPRSVVYASVGSVVLLSPGEVAEMAHGLVSTGRPFLWVVRLDTQPHLPAGFVESVSGRGAVVAWSPQERVLAHPSTACFLTHCGWNSTLETVAAGVPVVAFPQWGDQCTDARFLVEELGMGVRLRGARREAVREAVEAAVAGPRAGEMLASARRWSAAARAAVAPGGSSDAHVQAFVDEVARRARGGGAAKAEAQAAQPPPAVATEAS

SEQ ID NO: 4127 - protein, 165 aa, Saccharum officinarum
MEGEQKGGASGGVRDGEVRTAAAAAAVSLETLRKRMADFATERDWEQFHSPRNLLLALVGEVGELSEIFQWKGEVPKGLPGWDDGEKEHLGEELADVLLYLVRLSDMCGVDLGKAALRKMEINARKYPVGQCKGSSKKHTHYGSTNNVSDSDNANTPNKENNNGV

SEQ ID NO: 4128 - protein, 164 aa, Zea mays
MEREEKGGNVRDGEVRTTAAAAAAVSLETLRKRMADFATERDWEQFHSPRNLLLALVGEVGELSEIFQWKGEVPKGLPGWDDAEKEHLGEELADVLLYLVRLSDMCGVDLGKAALRKMEINARKYPVGQCKGSSKKHTHYGSTNNVGDSDKANAANKEQHSCGV

SEQ ID NO: 4129 - protein, 176 aa, Panicum virgatum
MNGGVEEVSVEEGKCGDGGAVRDGEMGTATEAEAAAAVSLEALRKRMADFARERDWEQFHSPRNLLLALVGEVGELSEIFQWKGEVPKGLPGWDEAEKVHLGEELADVLLYLVRLSDMCGVDLGKAALRKMEINACKYPVGQCKGSSKKHTHYGSTNSVSANDNVNTMNKEHNNGI

SEQ ID NO: 4130 - protein, 177 aa, Setaria italica
MNGGVEEASAEGEGKGGVGGGARGGEMGTATEAVAAVSLEALRKRMADFARERDWEQFHSPRNLLLALVGEMGELSEIFQWKGEVPKGLPGWDEAEKEHLGEELADVLLYLVRLSDMCGVDLGKAALRKMEINARKYPVGQCKGSSKKHTHYGSTNSVTASARDNVNTMNKEDNNGV

SEQ ID NO: 4131 - protein, 174 aa, Panicum virgatum
GGVEEVSVEEGKCGDGGAVRDGEMGTATEAEAAAAVSLEALRKRMADFARERDWEQFHSPRNLLLALVGEVGELSEIFQWKGEVPKGLPGWDEAEKVHLGEELADVLLYLVRLSDMCGVDLGKAALRKMEINACKYPVGQCKGSSKKHTHYGSTNSVSANDNVNTMNKEHNNGV

SEQ ID NO: 4132 - protein, 404 aa, Zea mays
MQSSAMAFFPSVATAKLELNSLYRKYVDMFGVSSNNSTVGSHTIHKMSHLPVLLVDRTFFSTGTAIQSIAISYGALIRRWLLGGTSVAQHAMISRAAMNSLPCCAFLPFFASVGALMTKLCGCTMIPDRFSGWQSVLGQSANLRGEPVLVVDNNELGNDQTLSSFLGRKRDYVGLGLALQCICYPACLKVAEFPQKNLSFSRQWMRSGHDTSAIWRAMARNEQYLAFVVVLAALQLFLRLARVNVTILFLPMLSQAVSSRSSPAVIGNVLLVLVTSCGVLGSALSVKQFGREVTFAIGAIVMVICQVAIPLIMEVQIGVGGGTRMPVGYTAATFALTCVVSCGLSWSWGSFFWTLPGRKVHSAGHVLAVALNLGVCFAQMRYFLLMLCRLKNATLAYYALWIWS

SEQ ID NO: 4133 - protein, 392 aa, Panicum virgatum
MSDNLMDKVSAFGERLKITGTEVSKKMTAGMSSMSFKMKELFQGQTPADKIVEDATSENLDGPDWNLNLEICDLINTEKVNSVELIRGIKKQIMLKDARIQYLSLILLETIVKNCEKAFSEVAAERVLDEMVRLIDDPQTVVNNRNKALMLIEAWGESGDELRYLPVYEETYKSLKSRGVRFPGRDNESLAPIFTPPRSVAEADIDANLPQQAFEDVHVHTYTAEETKEAFDVARNSIELLSTVLSSSPEQDALQDDLTATLVQQCYQSQHTIQRIIETVGDNEAVLFEALSVNDEIQKVLSKYEEMKQPRASEQAEQRPVVIPIATEHEDSTAVGTEDALVRKPVAARARSGGDDDILDDLDEMIFGKKGGSSSQEAPKKPDPKKDDLISF

SEQ ID NO: 4134 - protein, 392 aa, Panicum virgatum
MSDNLMDKVSAFGERLKITGTEVSKKMTAGMSSMSFKMKELFQGQTPADKIVEDATSENLDGPDWNLNLEICDLINTEKVNSVELIRGIKKQIMLKDARIQYLSLILLETIVKNCEKAFSEVAAERVLDEMVRLIDDPQTVVNNRNKALMLIEAWGESGDELRYLPVYEETYKSLKSRGVRFPGRDNESLAPIFTPPRSVAEADIDANLPQQAFEDMHVHTYTAEETKEAFDVARNSIELLSTVLSSSPEQDALQDDLTATLVQQCYQSQHTIQRIIETVGDNEAVLFEALSVNDEIQKVLSKYEEMKQPRASEQAEQRPVVIPIATEHEDSTAVGTEDALVRKPVAARARSGGDDDILDDLDEMIFGKKGGSSSQEAPKKPDPKKDDLISF

SEQ ID NO: 4135 - protein, 391 aa, Setaria italica
MSDNLMDKVSAFGERLKITGTEVSKKMTAGMSSMSFKMKELFQGQTPADKIVEDATSENLDGPDWNSNLEICDLVNTEKVNSVELIRGIKKRIMLKDARIQYLSLILLETIVKNCEKAFSEVAAERVLDEMVRLIDDPQTVVNNRNKALMLIEAWGESGDELRYLPVYEETYKSLKSRVRFPGRDNESLAPIFTPPRSVAEADIDANLQQQAFEDVHVHTYTAEETKEAFDVARNSIELLSTVLSSSPEQDALQDDLTSTLVQQCHQSQHTIQRIIETVGDNEAVLFEALSVNDEIQKVLSKYEEMKQPRASENAEQRPVVIPIATEHEDSAAVGNEDALVRKPAAARARSGGDDDILDDLDEMIFGKKGGSSSQEAPKKPDPKKDDLISF

SEQ ID NO: 4136 - protein, 391 aa, Zea mays
MSDNLMEKVSAFGERLKITGTEVSKKMTAGMSSMSFKMKELFQGQTPADKIVEDATSENLDGPDWNSNLEICDLINTEKVNSVELIHGIKKRIMMKDARVQYLSLVLLETIVKNCEKAFSEVAAERVLDEMVRLIDDPQTVVNNRNKALMLIEAWGESGDELRYLPVYEETYKSLKSRVRFPGRDNESLAPIFTPPRSVAEADVETSLPQQAFEDVHVHTYTAEETKEAFDVARNSIELLSTVLSSSPEQDASQDDLTATLVQQCYQSQHTIQRIIETVGDNEAVLFEALSVNDEIQKVLSKYEEMKQPRASEHAEQRAVVIPVATEHEDLTAAVNEDALVRKPAAARTRSGGDDDILDDLDEMIFGKKGGSSSQEGPKKPDPKKDDLITF

SEQ ID NO: 4137 - protein, 392 aa, Panicum virgatum
MSDNLMDKVSAFGERLKITGTEVSKKMTAGMSSMSFKMKELFQGQTPADKIVEDATSENLDGPDWNLNLEICDMINTEKVNSVELIRGIKKRIMLKDARIQYLSLILLETIVKNCEKAFSEVAAERVLDEMVRLIDDPQTVVNNRNKALMLIEAWGESGDELRYLPVYEETYKSLKSRGVRFPGRDNESLAPIFTPPRSVAEADIHANLPQQAFEDVHVHTYTAEETKEAFDVARNSIELLSTVLSSSPEQDALQDDLTATLVQQCYQSQHTIQRIIETVGDNEAVLFEALSVNDEIQKVLSKYEEMKQPMASEQAEQRPVVIPIATEHEDSTAAGTEDALVRKPAAARARSGGDDDILDDLDEMIFGKKGGSSSHEAPKKPDPKKDDLISF

SEQ ID NO: 4138 - protein, 392 aa, Pennisetum glaucum
MSDNLMDKVSAFGERLKITGTEVSKKMTAGMSSMSFKMKELFQGQTPADKIVEDATSENLDGPDWNLNLEICDLVNTEKVNSVELIRGIKKRIMLKDARIQYLSLILLETIVKNCEKAFSEVAAERVLDEMVRLIDDPQTVVNNRNKALMLIEAWGESGDELRYLPVYEETYKSLKSRGVRFPGRDNESLAPIFTPPRSVAEADIDANLPQQAFEDVHVHTYTAEETKEAFDVARNSIELLSTVLSSSPEQDALQDDLTSTLVQQCHQSQHTIQRIIETVGDNEAVLFEALSVNDEIQKVLSKYEEMKQPRASENAEQRPVVIPIATEHEDSAAVGNEDALVRKPAGARSRSGGDDDILDDLDEMIFGKKGGSSSQEAPKKTDSKKDDLISF

SEQ ID NO: 4139 - protein, 392 aa, Zea mays
MSDNLMDKVSAFGERLKITGTEVSKKMTAGMSSMSFKMKELFQGQTPADKIVEGATSEDLDGPDWNSNLEICDMINTEKVDSVELIRGIKKRIMLKDARVQYLSLVLLETIVKNCDKAFSEVAAERVLDEMVRLIDDPQTVVNNRNKALMLIEAWGESGDELRYLPVYEETYKSLKSRGVRFPGRDNESLAPIFTPARSVAEADVDASLPQQVFEDVHVHTYTAEETKEAFDVARNSVELLSTVLSSSPEQDALQDDLTTTLVQQCYQSQHTIQMIIETVGDNEAVLFEALSVNDEIQKVLSKYEEMKQPRASEHAEHVPVVIPIAAEHEDLNAVGNEDALVRKPAAARATSGGDDDILDDLDEMIFGKKGGSSSQEGPKKPDPKKDDLISF

SEQ ID NO: 4140 - protein, 392 aa, Oryza sativa
MSDNLMDKVSAFGERLKITGSEVSKKMTAGMSSMSFKMKEIFQGQTPADKIVEEATSENLDGPDWSANLEICDLINTEKVNSVELIRGIKKRIMLKDARVQYLSLVLLETIVKNCEKAFSEVAAERVLDEMVRLIDDPQTVVNNRNKALMLIEAWGESGDELRYLPVYEETYKSLKSRGVRFPGRDNESLAPIFTPARSVAEAEVDANFSQQTFEDVQVHTYTAEETKEAFDVARNSIELLSTVLSSSPQQDALQDDLTSTLVQQCYQSQHTIQRMIETAGDNEAMLFEALSVNDEIQKVLSKYEQMKKPAASENAEQRPVVIPIATEHEDSATVGNEDALVRKPAGSRARSGGDDDILDDLDEMIFGKKGGSSSQEGPKKQDPKKDDLISF

SEQ ID NO: 4141 - protein, 391 aa, Brachypodium distachyon
MGDNLMEKVNALGERLKITGSEVSKQMAAGMSSMSFKMKELFQAPTPADKIVEDATAENLEGPDWSANLEICDLINTEKVNSVDLIRGIKKRIVLKEARVQFLSLFLLETIVKNCEKAFSEVAAERVLDEMVKLIDDPQTVVNNRNKALMLIEAWGESGDELRYLPVYEETYKSLKSRGVRFPGRDNESLVPIFTPPRSVAEAEADANFSQQTFEDVHVHTYTAEETKEAFDVARNSMELLSTVLSSSPQQDALQDDLTTTLVQQCYQSQHTIQRFVETAGDNEAMLFEALSVNDEIQKVLSKYEEMKKPMISEHAEQPVVIPIATEHEDSATVGNEDALVRKPAGSRAMSGGDDDILDDLDEMIFGKKGGSSSQEVPKRQDPKKDDLINF

SEQ ID NO: 4142 - protein, 392 aa, Avena sativa
MSDNLMEKVNALGERLKITGTEVSKQMAAGMSSMSFKMKELFQAQTPADKIVEDATAENLEGPDWAANLEICDLINTEKVNSVDLIRGIKKRIMLKEARVQFLALFLLETIVKNCEKAFSEVAAERVLDEMVRLIDDPQTVVNNRNKALTLIEAWGESGNELRYLPVYEETYKSLKSRGVRFPGRDNESLAPIFTPPRSVAEAEVEANFSHQAFEDVHVHTYTAEETKEALDVARNSMELLSTVLSSSPQQDVLQDDLTTTLVQQCYQSQHTIQRFIETAGDDEALLFEALSVNDEIQKMLSKYEEMKKPTAPTHTEQPVVIPIATEHEDPGFVGNEDALVRKPAASRAMSGGDDDILDDLDEMIFGKKGGGSSSQEGPKRQDPKKDDLINF

SEQ ID NO: 4143 - protein, 391 aa, Triticum aestivum
MSDNLMEKVNALGERLKITGSEVSKQMQAGMSSMSFKMKELFQAQTPADKIVEDATAETLEGPDWAANLEICDLINTEKVNSVDLIRGIKKRIMLKEARVQFLALFLLETIVKNCEKAFSEVAAERILDEMVRLIDDPQTVVNNRNKALTLIEAWGESGDELRYLPVYEQTYKSLKSRGIRFPGRDNESLAPIFTPPRSVAEAEVAANFSQQIFEDVHVHTYTAEETKEAFDVARNSMELLSTVLSSSPQQDALQDDLTTTLVQQCYQSQHTIQRFIETAGDNEALLFEALSVNDEVLKVLSKYEEMKKPMASARTEQPVVIPIATEHEDSVTVGNEDALVRKPAAARAMSGGDDDILDDLDEMIFGKKGGSSSQDVSKRQDPKKDDLINF

SEQ ID NO: 4144 - protein, 392 aa, Brachypodium distachyon
MNDNLMDKVTALSERLKITGSEVSKKMTAGMSSMSFKMKELFQAQTPADKFVEEATSENLDGPDWSANLEICDLINSEKVNSVDLIRGIKKRIVLKDARVQFLSLFLLETVAKNCEKAFSEIAAERVLDEMVRLIDDPQTVVNNRNKALMLIEAWGESGEELRYLPVYEETYKSLKSRGVRFPGRDNESLVPIFTPPRSVAEAEVQANFTQQTFEDVHVHTYTAEETKEAFDVARNSIELLSTVLSSSPQQDALQDDLTTTLVQQCYQSQHTIQRFVETAGDNEAMLFEALSVNDEIQKVLSRYEEMKKPLASANAEHEPVVIPIATEHEDSATVGSEDALVRKPAGSRARPGADDDILDDLDEMIFGKKGGSSSQEGPQKQDPKKDDLINF

SEQ ID NO: 4145 - protein, 391 aa, Hordeum vulgare
MSDNLMEKVNALGERLKITGSEVSKQMQAGMSSMSFKMKELFQAQTPADKIVEDATAESLEGPDWAANLEICDLINTEQVNSVDLIRGIKKRIVLKEARVQFLALFLLETIVKNCEKAFSEVAAEKILDEMVRLIDDPQTVVNNRNKALTLIEAWGESGDELRYLPVYEQTYKSLKSRGIRFPGRDNESLAPIFTPPRSVAEAEAAANFSQQAFEDVHVHTYTAEETKEAFDVARNSMELLSTVLSSSPQQDALQDDLTTTLVQQCYQSQHTIQRFIETAGDNEALLFEALSVNDEVQKVLSKYEEMKKPMASARTEQPVVIPIATEHEDSVTVGNEDALVRKPAAARAMSGGDDDILDDLDEMIFGKKGGSSSQDVSKRQDPKKDDLINF

SEQ ID NO: 4146 - protein, 357 aa, Cenchrus ciliaris
FKMKELFQGQTPADKIVEDATSENLDGPDWNLNLEICDLVNTEKVNSVELIRGIKKRIMLKDARIQYLSLILLETIVKNCEKAFSEVAAERVLDEMVRLIDDPQTVVNNRNKALMLIEAWGESGDELRYLPVYEETYKSLKSRGVRFPGRDNESLAPIFTPPRSVAEADIDANLPQQAFEDVHVHTYTAEETKEAFDVARNSIELLSTVLSSSPEQDALQDDLTSTLVQQCHQSRHTIQRIIETVSDNEAVLFEALSVNDEIQKVLSKYEEMKQPRASENAEQRPVVIPIATEHEDSAAVGNEDALVRKPAGARARSSGDDDILDDLDEMIFGKKGGSSSQEAPKKPDPKKDDLISF

SEQ ID NO: 4147 - protein, 391 aa, Secale cereale
MSDNLMEKVNALGERLKITGSEVGKQMQAGMSSMSFKMKELFQAQTPADKIVEDATAEGLEGPDWAANLEICDLVNTERVNSVDLIRGIKKRIMLKEARVQFLALFLLETIVKNCEKAFSEVAAERILDEMVRLIDDPQTVVNNRNKALTLIEAWGESGDELRYLPVYEQTYKSLKSRGIRFPGRDNESLAPIFTPPRSVAEAEVAANFSQQTFEDVHVHTYTAEETKEAFDVARNSMELLSTVLSSSPQQDALQDDLTTTLVQQCYQSQHTIQRFIETAGDNEALLFEALSVNDEVQKVLSKYDEMKKPMASARTEQPVVIPIATEHEDSGAVGNEDALVRKPAAARAMSGGDDDILDDLDEMIFGKKGGSSSQEASKRQDLKKDDLINF

SEQ ID NO: 4148 - protein, 399 aa, Secale cereale
MGDNLMDKVTALSEQLKITGTEVGKKMTAGMSSMSFKMRELFLGQTPADKIVEDATSESLEGPDWAMNLEICDLINAEKVNSVDLVRGIKKRLVLKDARVQFLSLSLLETVTKNCEKVFSEVAAEKVLDEMVRLVDDPLTVVNNRNKALMLIEAWGESGEELRYLPVYEETYKSLKSRGVRFPGRDNESLVPIFTPPRSVAEAEAGANFTQQTFEDVHMHTYTAEETKEAFDVARNSIELLSTVLSSSPQQDALQDDLTNTLVQQCYQSQHTIQRFVETAGDNEAMLFEALTVNDEIQKVLSRYEEMKKPVAPAHTEQEPVVIPIAAEAEHEDAAAVGSEEALVRKPAGARAKLGEDDGMLDDLDEMIFGKKGGDSSSSQEDADGAQKQDKKKDDLINL

SEQ ID NO: 4149 - protein, 181 aa, Zea mays
MEAYFLFHSGRAHEFAYAEQEEDIGSPSDSEPPSTSTSRESAGSSAELDDDATSSGSGSGSDRFEMSALMTQLPPFKRGLSRFFDGKSQSFASLAAVGSLEDLPKPARKRLKPSRSCGGALDAHRGRLLSPRRHYCTKPTARTRKAAARSGTLSVLAAGAPRMPPAVARAEGVAAKVLIVS

SEQ ID NO: 4150 - protein, 219 aa, Saccharum officinarum
MGFPVGYSEMLLPRVLLQVLLILCHLHRFLLWAFHAVGLGDLIDLGCNYPPPPSSAPTTAAAQEHQHQHQGRDDVAAPLQHRRPDFRSVPAVLVDEALPVVRFDELAGTACGDGDCAVCLSGIGGGDEVRRLNNCRHAFHRACLDRWMAHDQRTCPLCRAPLIPGAADPWAAGVAPWPDAGDYDMSYPSSLPSTPLLALPTPTLLRPHELLLTGLGGFQ

SEQ ID NO: 4151 - protein, 218 aa, Panicum virgatum
MGFPVGYPEMLLPRALLQALLLLGHLHRFLLWAFHAVGLGDLIDLGCNDYYYPAPPSAAAERTTGRDAAAPPLQHRRPEFRPVPAVLVEEALPVVRFEELAAPACGGGDCAVCLSGIGAADEVHRLSNCRHAFHRGCLDRWMAHDQRTCPLCRAPLIPGSAAAGDPGWAAAAAPWADAATDYDMSYPSSLPSTPLLMVPTPTLLRPHELLLTGLGGFQ

SEQ ID NO: 4152 - protein, 213 aa, Panicum virgatum
MGFPVGYSEMLLPRALLQVLLLLGHLHRFLLWAFHAVGLGDLIDLACNDYPAPPSAAVAERAVAPPLQHRRPEFRPVPAVLVEEALPVVRFEELAGTACGGGDCAVCLSGIGAGDEVRRLSNCRHAFHRGCLDHWMAHDQRTCPLCRAPLIPGSVAAGDPTGWAAAAAPWSDAAAEYDMSYPSSLPSTPLLMVPTPTLLRPHELLLNGLGGFQ

SEQ ID NO: 4153 - protein, 212 aa, Setaria italica
MGFPVGYSEMLLPRVLLQVLLLLGHLHRFLLWAFHAVGLGDLIDLGCNNYPLPASAAAAVQEQPGRDAVLAPLQHRRPEFRTVPAVHIEEALPVVRFEELAGTACGGGDCAVCLSGIGAGDEVRRLSNCRHAFHRGCLDHWMAHDQRTCPLCRAPLIPGAAGAAAGDPWGASAADYDMSYPSSLPSTPLLTVPTPTLLRPHELLLNGLGGFQ

SEQ ID NO: 4154 - protein, 568 aa, Zea mays
MSYCAGATAAFRDADGAGEEALTACLLPKTEVRLAVEDLPPVLTSKPPGRFARAVKEAWSVSLSVTFPMMPSMSAGAAGAEARSILSLALPMILTGLLLYLRSMISMLFLGRLSGLALAGGSLAIGFANITGYSVLSGLAMGMEPICGQAFGAGHYELLGVTTQRGVLMLLAAAVPIGGLWVHIRPLLLLCGQDAGIAAVAETYILASLPDLLLQAFLHPVRIYLRTQSINLPLTLCATLAIALHLPINYVLVSVLGLGIRGVALASVLANLNLLLFLFAYILFKGVHKRTGGFALSAESFRGWGELVSLALPSCVSVCLEWWWYEIMILLCGLLANPQATVASMGILIQTTSLIYIFPSSLGLGVSTRVSNELGANRPDHAGRAATVGLMLGFAFGGVASAFAYLVRGAWATMFTADPAIVALTAAVLPILGACELGNCPQTTGCGVLRGSARPKDAASINLRSFYLVGTPVALVLAFWYHYDFQGLWLGLLAAQATCVVRMLLVIGGTDWVAEAKRAQQLTGARTVEETKESSGKSSHVVEVTAAGGDEELGLPIDVVIDRPKDQC

SEQ ID NO: 4155 - protein, 562 aa, Setaria italica
MSLSCGAATVACRDAAGEEALLAASLLLPKAEVLVPVEDELTAPPVLTRKPRGRLARAVKEAWSVSLSVTFPMMPSMSAGAAGAEARSILGLALPMILTGLLLYLRSMISMLFLGRLGGLALAGGSLAIGFANITGYSVLSGLAMGMEPICGQAFGAGHYELLGVTTQRTVLMLLAAAVPIGGLWAHMRPLLLLCGQDAGIAAVAETYILASLPDLLLQAFLHPVRIYLRTQSINLPLTLCAALAIALHLPINYVLVSVLGLGIRGVALASVLANLNLLLFLLAYILFKGVHRRTGGFALSAESFRGWGELAGLALPSCVSVCLEWWWYEIMILLCGLLADPQATVASMGILIQTTSLIYIFPSSLGFGVSTRVSNELGANRPDQAGRAATAGLMLGFAFGGVASAFAWLVRGAWATMFTADPAIVALTASVLPILGACELGNCPQTAGCGVLRGSARPKDAASINLRSFYLVGTPVALVLAFWYHYDFQGLWLGLLAAQAACVVRMLLVIGRTDWAAEAKRAQQLAGAAGAVETKEGMEVGGDDKPGVTIDVVIERPKDQC

SEQ ID NO: 4156 - protein, 556 aa, Panicum virgatum
MSSCAAAAAAGEEALLTAPLLAPVVAVAGELLPPVLPARKPRGRLARAVKEAWSVSLSVTFPMAPSVSAAAAGAEARSILGLALPMILTGLLLYLRSMISMLFLGRLGGLALAGGSLAIGFANITGYSVLSGLAMGMEPICGQAFGAGHNTLLGVTTQRTVLMLLAAAVPIAGLWAHMRPLLLLCGQDAGIAAAAETYILASLPDLLLQALLHPVRIYLRAQSINLPLTLCAALAIALHLPINYVLVSVLGLGIRGVAFASVLANLNLVLFLLAYILIRGVHRRTDGFALSPESFRGWGELAGLALPSCVSVCLEWWWYEIMILLCGLLANPQATVASMGILIQTTSLIYIFPSSLGFGVSTRVSNELGANRPAHAARAATVGLVLGFAFGGAASAFAYLVRGAWAAMFTADPAIVALTASVLPILGACELGNCPQTAGCGVLRGSARPKDAASINLRSFYLVGTPVALVLAFWYHYDFQGLWLGLLAAQAACVVRMLLVIGRTDWAAEAKRAQQLAGAGGAVEIKDGMEVGAAGGDDEPSMPIVVVIERPPKDQC

SEQ ID NO: 4157 - protein, 562 aa, Panicum virgatum
MSSRAAAAVACGDAAGAGEATLFTAPLLAPEAGEGEMPPPPVLLSRKPRGRLARAVKEAWSVSLSVTFPMAPSVSVAAAGAEARSILGLALPMILTGLLLYLRSMISMLFLGRLGGLALAGGSLAIGFANITGYSVLSGLAMGMEPICGQAFGAGHHGLLGVTTQRTVLMLLAAAVPIGGLWAHMRPLLLLCGQDAGIAAAAETYILASLPDLLLQALLHPVRIYLRAQSINLPLTLCAALAIALHLPINYVLVSVLGLGIRGVALASVLANLNLVLFLFAYILIWGVHRRTGGFALSAESFRGWGELAGLALPSCVSVCLEWWWYEIMILLCGLLANPQATVASMGILIQTTSLIYIFPSSLGLGVSTRVSNELGANRPDHAARAATVGLVLGFAFGGVASTFAYLVRGAWAAMFTADPAIVALTASVLPILGACELGNCPQTAGCGVLRGSARPKDAASINLRSFYLVGTPVALVLAFWYHYDFQGLWLGLLAAQAACVVRMLLVIGRTDWTAEAKRAQQLAGAGGALEIKDGMEVGAAGGDDDPGMPIVVVIERPKDQC

SEQ ID NO: 4158 - protein, 582 aa, Brachypodium distachyon
MSSRSDATVACRDGSPAGHGVTASLLSKAEFVVPVPVPVEEELLPPVLTSKPTPSADRLARAVKEAWSVSLSVTFPMLPSMSAAAAGEEARSILGLAMPMILTGLLLYLRSMISMLFLGRLGGLALAGGSLAIGFANITGYSVLSGLAMGMEPICGQAFGAGHYELLGVTMQRTVLLLVAAAVPIGGLWMHMRPLLLLCGQDVGIAAVAETYILASLPDLLLQAFLHPVRIYLRTQSINLPLTVCAALAIALHLPINYVLVSVLGHGIRGVALASVLANLNFLLLLLGYILCKGVHRRTGSFFALSADSFRGWGELVSLALPSCVGVCLEWWWYEIMILLCGLLANPQATVASMGILIQTTSLIYIFPSSLGFGVSTRVSNELGANRAERAGRAATVGLMLGFAFGGAASAFAYAVRGSWAAMFTADPAIVALTASVLPILGACELGNCPQTAGCGVLRGSARPKDAASINLRSFYLVGTPVALVLAFWFRYDFQGLWLGLLAAQAACVVRMLLVIGRTDWEAEAKRAQQLTAAGCVVAAPVVYTKQSSGKGIHVARVPAAGGDEESGLLVDVVIEQPKDEC

SEQ ID NO: 4159 - protein, 288 aa, Triticum aestivum
MSSCSDSTVTMSYRHGEHAGDGITAPLLPKAEVVVPMEELPPVLTCKPPGRLARAVKEAWSVSLSLAFPMLPSMSAAAAGEEARSILGLAMPMILTGLLLYLRSMISMLFLGRLGGLALAGGSLAIGFANITGYSVLSGLAMGMEPICGQAFGAGHYELLGVTMQRTVLLLARRCSHRRAVDAYATSALALRPGRRHRSGRRDLHSFLPAGPPPPGIPPPRPHLPPDAIHQLAAHRVRRARHCTPPAHQLRARLRPRTRHQGGGICLCSRQPKLPSPPSWLHIGQGSA

SEQ ID NO: 4160 - protein, 572 aa, Hordeum vulgare
MSSCSNATVTVSCRHGEDAGDGITASLLPIAEVVVPVEEPPPVLTCKPPGRLAIAVKEAWSVSLSLTFLMLPSMSAAAAGEEARSILGLAMPMILTGLLLYLRSMISMLFLGRLGGLALAGGSLAIGFANITGYSVLSGLAMGMEPICGQAFGAGHYELLGVTMQRTVLLLVAAAVPIGGLWMHMRPLLLLCGQDVGIAAVAETYILASLPDLLLQAFLHPVRIYLRSQSINLPLTVCAALAIALHLPINYLLVSVLGHGIRGVAVASVLANLNFLLFLLGYVLYKGVHKRTGGFAFSAESFRGWGELVRLAVPSCVSVCLEWWWYEIMILLCGLLANPQSTVASMGILIQTTSLIYIFPSSLGFGVSTRVSNELGANRAVRAGRAATVGLMLGFAFGAVASAFAYLVRGSWATIFTADPAIIALTASVLPILGACELGNCPQTAGCGVLRGSARPKDAASINLRSFYLVGTPVALVLAFWYHYDFQGLWLGLLAAQAACMVRMLLVIGRTDWAAEAKRAQQLTGAGVVTVAVDTKPSSGEGIHVVRIAAGGGDENSGLLVDVVVEQPNDQR

SEQ ID NO: 4161 - protein, 549 aa, Oryza sativa
MSSPRRDGRGAVDDLTASLLHKGDGGEAVFVVVVVPPVAEEEEPPPVLTCKPPGRFARAVKEAWSVPFPMMPSMSAGAAGAEARSILGLALPMILTGLLLYLRSMISMLFLGRLGGLALAGGSLAIGFANITGYSVLSGLAMGMEPICGQAFGAGHYDLLGVTMQRTVLLLVAASVPIAGLWVHMRPLLLLCGQDAAIAAVAETYILASLPDLLLQAFLHPVRIYLRTQSINLPLTVCAALAIALHLPINYVAVSVLGLGIKGVALASVLANLNLVLFLFGYIWFKGVHKRTGGFALSADCLRGWGELVSLALPSCISVCLEWWWYEIMILLCGLLANPQATVASMGILIQTTSLIYIFPSSLGFGVSTRVSNELGANRPERACRAATVGLMLGFAFGGVASAFACHVRGAWATMFTADPAIVALTASVLPILGACELGNCPQTTGCGVLRGSARPKDAASINLRSFYLVGTPVALILAFWYHYDFRGLWLGLLAAQATCVVRMLLVIGETDWTAEAKRAQQLTGAADIKDCGGKGDHVAVIEQPDEQC

SEQ ID NO: 4162 - protein, 555 aa, Triticum aestivum
MTSCGGATAACPDGRVITAPLLAKPGEVVVQVCGDEAAAPVLTCKPPGRLARAVKEAWSVSLGIALPMMPPVSATAARDEARSILGLAFPMILTGLLLYLRSMISMLFLGRLGGLALAGGSLAIGFANITGYSVLSGLAMGMEPICGQAFGAGNYSLIGVTVQRTVLLLIAAAVPIGGLWMHMRPLLLLCGQDAAIAAVAETYILASLPDLLLQAFLHPVRIYLRMQSINLPLTVCATLAIAIHLPINYVLVTVLGLGVKGVAMASVLANLNLLLLLLAYIFFKGVHKRTGGFALSAESFRGWGELISLALPSCVSVCLEWWWYEIMILLCGLLLNPQATVASMGILIQTTSLIYIFPSSLSFGVSTRVSNELGAGQPEQASRAATAGIMLGFAFGAFASAFAFLVRNVWASMFTADPAIIALTASVLPILGLCELGNCPQTTGCGVLRGSARPKDAANINLRSFYLVGTPVALVLAFWFHYDFEGLWLGLLAAQATCMVRMLLVIGRTDWAGEAKRSKQLTGSDAQGKVGAADGDEKSRLLIDDADIERPNDRC

SEQ ID NO: 4163 - protein, 552 aa, Hordeum vulgare
MTSCGGATAACPDGCAITAPLLAKAGEVVIPVYADEAAAPVLTCKPPGRLATAVKEAWSVSLGIALPMMPPVSAAAARDEARSILGLAFPMILTGLLLYLRSMISMLFLGRLGGLALAGGSLAIGFANITGYSVLSGLAMGMEPICGQAFGAGNYSLIGLTVQRTVLLLIAAAVPIGGLWMHMRPLLLLCGQDAGIAAVAETYILASLPDLLLQAFLHPVRIYLRMQSVNLPLTVCATLAIAIHLPINYVLVTVLGLGVKGVAMASVLANLNLLLLLLAYIFFKGVHKRTGGFALSAESFRGWGELISLALPSCVSVCLEWWWYEIMILLCGLLLNPQATVASMGILIQTTSLIYIFPSSLSFGVSTRVSNELGAGQPEQASRAATAGIMLGFAFGALASAFAFLVRDVWASMFTADPAIIALTASVLPILGLCELGNCPQTTGCGVLRGSARPKDAANINLRSFYLVGTPVALVLAFWFHYDFKGLWFGLLAAQATCMVRMLLVIGRTDWAAEAKRSKQLTGQDKVGAADGDEKSRLLIDAADIEQPNDRC

SEQ ID NO: 4164 - protein, 333 aa, Saccharum officinarum
MASSSAAEPSSRISDRARRSSLGLRFMVLLMHVLFVGAVFILDPTLDWRIHEQPWYIGLYGVLVLLTLVQYFYTAGSSPGYVIDVMRAGSMMHATFVNTAALSKQSNSRNGNTNSPTSRAQLQKLSTVTPTSSWAQMVMDLYPPGSSSRDWTCAYCRVVQPPRTRHCHDCDKCVLQFDHHCIWLGTCIGKKNHCRFWWYIFEETILCIWTAALYIESLRLDVDKAWWKDFVGVILLAVLIFILIFLLLLWLFHSYIAVTNQTTYEVARRKRIFYLRGVPERVHPFSRGICRNLYDFCCSSQKGYILEAVPPSEELEARAARYTCRDVICCHCC

SEQ ID NO: 4165 - protein, 333 aa, Setaria italica
MASSSAAEPGTRLSDRVRRSSLGLRFMVLLMHVLFVGAVFFLDPTLDWRIHEEPWYIGVYGVLVLLTLVQYFYTAGSSPGYVVDVMRAGSSMHATFVNTAALSKQSNSRNGNISSPTSRAQLQKLSTMTPSSSWAQMVMDLYPPGSSSRDWTCTYCRVVQPPRTRHCHDCDKCVLQFDHHCIWLGTCIGKKNHCRFWWYIFQETILCIWTAALYIESLRLDVDKAWWKDFVGVILLAVLIFILIFLLLLLGFHSYIALTNQTTYEVARRKRIFYLRGVPERVHPFSKGICRNLYDFCCSSQKGYILEALPPAEDLEARAARYTCRDVICCRCC

SEQ ID NO: 4166 - protein, 332 aa, Zea mays
MASSSAVEPSFRLSDRERRSSLGLRFTVLLMHVVFVGAVFILDPTLDWRIHEEPWYIGLYGVLVLLTLVQYFYTAGSSPGYVIDVMRAGSMMHATFVNTAALSKQSNSRNGNTNSPTSHAQLQKLSAMTPTSWAQMVVDLYPPGSNSRDWTCTHCRVVQPPRTRHCHDCDKCVLQFDHHCIWLGTCIGKKNHCRFWWYISEETILCIWTAVLYIESLRLDVDKAWWKDFVGVILLAVLIFILIFLLLLWLFHSYIAVTNQTTYEVARRKRIFYLRGVPERVHPFSRGICRNLYDFCCSSQKGYILEAVPPREELEARAARYTCRDVICCRCC

SEQ ID NO: 4167 - protein, 333 aa, Zea mays
MASSSAAESSSRLSDRARRSALGLRFMVLLMHVLFVGAVFILDPTLDWRIHGEPWYIGLYGVLVLLTLVQYFYTAGSCPGYVIDVMRAGSMMHATFVNTAALSKQSNSRNGNINSPTSRAQLQKLSTMTPTSSWAQMVMDLYPPGSSSRDWTCTYCRIVQPPRTRHCHDCDKCVLQFDHHCIWLGTCIGKRNHCRFLWYIFEETILCIWTAALCIESLCLDVDKAWWKDFVGVILLAALILILIFLLLLWLFHSYIALTNQTTYEIARRKRIFYLRGVPERVLPFSKGICRNLYDFCCSSQKGYILEAVPPSEELEARAARYTCRDVICCRCC

SEQ ID NO: 4168 - protein, 334 aa, Panicum virgatum
MASSSAAEIGTRVFSDRARRSSVGLRFMVLLMHVLFVGAVFVLDPTLGRRIHEEPWYIGVYGVLVLLTLVQYFYTAGSSPGYVVDVMRAGSTMHATFVNTATLSKQSNSRNGNISSPTSRAQLQKLTTMTPTSSWAQMVMDLYPPGSSCRDWTCTYCRVVQPPRTRHCHDCDKCVLQFDHHCIWLGTCIGKKNHCRFWWYIFEETILCIWTAALYIESLRLDVDKAWWKDFVGVILLAVLIFILIFLLLLLGFHTYIALTNQTTYEVARRKRISYLRGVPERVHPFSKGICRNLYDFCCSSQKGYILEALPPTEELEARAARYTFRDVICCRCC

SEQ ID NO: 4169 - protein, 333 aa, Pennisetum glaucum
MASSSSAEPGTRLSDRVRRSSLGLRFMVLLMHVLFVSAVFFLDPTLDWRIQEEPWYIGVYGVLVLLALVQYFYTAGSSPGYVVDVMRAGSTMHATFVNTAALSKQSNSRNGNISSPTSRAQLQKLSTMTPSSSWAQMVMDLYPPGSNSRDWTCTYCRVVQPPRTRHCHDCDKCVLQFDHHCIWLGTCIGKKNHCRFWWYIFEETILSIWTAALYIESIRLDVDKAWWKDFVGVILLAVLIFILVFLLLLLGFHSYIALTNQTTYEVARRKRIFYLRGVPERVHPFSKGICRNLYDFCCSSQKGYILEALPPVEDLEARAARYTCQDVICCRCC

SEQ ID NO: 4170 - protein, 334 aa, Panicum virgatum
MASSSAAEIGTRVFSDRARRSSVGLRFMVLLMHVLFVGAVFVLDPTLGRRIHEEPWYIGVYGVLVLLTLVQYFYTAGSSPGYVVDVMRAGSTMHATFVNTATLSKQSNSRNGNISSPTSRAQLQKLTTMTPTSSWAQIVMDLYPPGSSSRDWTCTYCRVVQPPRTRHCHDCDKCVLQFDHHCIWLGTCIGKKNHCRFWWYIFEETILCIWTVALYIESLCLDLDKAWWKDFVGVILLAVLIFILIFLLLLLGFHTYIALTNQTTYEVARRKRIFYLRGVPERVHPFSKGICRNLYDFCCSSQKGFILEALPPTEELEARAALYTCRDVICCRCC

SEQ ID NO: 4171 - protein, 333 aa, Panicum virgatum
MASYSAAEPGIRLTDRARRSSVGLRFMVLLMHVLFVGAVFVLDPSLGWRIHEEPWYIGVYGVLVLLTLVQYLYTAGSSPGYVIDVMRAGSTMHATFVNTATLSKQSNSRNGNISSPTSRAQLQKLTTMTPTSSWAQIVMDLYPPGSSSRDWTCTYCRVVQPPRTRHCHDCDKCVLQFDHHCIWLGTCIGKKNHCRFWWYIFEETILCIWTVALYIESLCLDLDKAWWKDFVGVILLAVLIFILIFLLLLLGFHTYIALTNQTTYEVARRKRIFYLRGVPERVHPFSKGICRNLYDFCCSSQKGFILEALPPTEELEARAALYTCRDVICCRCC

SEQ ID NO: 4172 - protein, 700 aa, Zea mays
MDCDLFAAWWSSSTRLVSRIFRGSADAPGPSPARPAMPLHQKQAGLAASKLGVGTSKKHRAFVASDEQWYNKIFDPSSDFILTWNRIFLFSCFVALFIDPLYFYVPKISYGSPKFCIGTDTRFAVGVTFFRSIADLLYVLHIIIKFRTAYINPSSTLRVFGRGDLVTNPKEIAWKYIRSDLAVDVAAALPLPQIIVWFVIPAIKYSSAEHNNNILVLIVLAQYLPRLYLIFPLTYEIVKATGVVAKTAWEGAAYNMVLYLIASHVLGALWYLLSVDRQTFCWKTNCLNETGCDLKYLDCDTTPNATWANTTAVFSNCNASDTNISFDFGMFEPALSNQAPAQSFAMKYFYSLWWGLQNLSCYGQTLTVSTYLGETLYCIFLAVLGLVLFAHLIGNVQTYLQSITVRVEEWRLKQRDTEEWMRHRQLPCELRERVRRFIQYKWLATRGVNEESILHALPADLRRDIKRHLCLGLVRRVPFFSQMDDQLLDAICERLVSSLCTKGTYIVREGDPVTEMLFIIRGKLESSTTNGGRTGFFNSITLKPGDFCGEELLGWALVPRPTTNLPSSTRTVKALIEVEAFALQAEDLKFVASQFRRLHSKKLQHTFRYYSHHWRTWASCFIQAAWRRYKRRKMAKDLSMRESFNSVRLDEVDNEDDDSPPKNSLALKFIARTRKVPQNMKELPKITKPDEPDFSAEPED

SEQ ID NO: 4173 - protein, 699 aa, Panicum virgatum
MDCDLFAAWWRSSTGLFSRIFRGSADPLGPLPMKPAIPLHQKQAGLAASKLGVGTSKKHRAFVAGDEQWYNKIFDPSSDFILTWNRVFLVSCFAALFIDPLYFYVPKISYGSPNSCVGTDTHLAVIVTLLRSVADLLYVMHIIIKFRTAYINPSATLRVFGRGDLVTNPKEIAWKYLRSDCAVDVVAALPLPQIIIWFVIPAIKYSTSEHNNNILVLIVLAQYLPRLYLIFPLTYEIVKATGVVAKTAWEGAAYNLVLYLIASHVLGALWYLLSVDRQTACWKMNCRDEIGCAIKFLDCDDTPNETWANTTTTFSKCNASNGTIDFDFGMFLPALQNQAPAKSFVMKYFYSLWWGLQNLSCYGQTLVVSTYLGETLYCIFLAVLGLVLFAHLIGNVQTYLQSITVRVEEWRLKQRDTEEWMRHRQLPHELRERVRRFIQYKWLATRGVNEESILQALPADLRRDIKRHLCLGLVRRVPFFSQMDDQLLDAINERLVSSLCTKGTYIVREGDPVTEMLFIIRGKLESSTTNGGRTGFFNSITLKPGDFCGEELLGWALVPKPTTNLPSSTRTVKALIEVEAFSLQAEDLKFVASQFRRLHSKKLQHTFRYYSHHWRTWASCFIQAAWRRYKRRKMAKDLSMRESFNSIRLDEVDEEDESPAKNSLALKFIARTRKVPQSTKELPKLRKPDEPDFSAEPDD

SEQ ID NO: 4174 - protein, 698 aa, Panicum virgatum
MDCDLFAAWWGSATRLFSRIFRGSSDPPGQPPMKPAIPLHQKQAGLAASKLGVGTSKKHRAFVAGDEQWYNKIFDPSSDFILTWHRVFLVSCFAALFIDPLYFYVPKISYSSSISCVGTDTHLAVIVTLLRSVTDLLYVLHIIIKFRTAYINPSATLRVFGRGDLVTNPREIAWKYLRSDFAVDVVAALPLPQIIIWFVIPAIKYSTSEHNNNILVLIVLAQYLPRLYLIFPLTYEIVKATGVVAKTAWEGAAYNLVLYLIASHVLGALWYLLSVDRQTACWKKNCRDEIGCAIKFLDCDTPNRTWANTTTIFKKCNASDDTIDFDFGMFLPALTNQAPAESFVMKYFYSLWWGLQNLSCYGQTLVVSTYLGETLYCIFLAVLGLVLFAHLIGNVQTYLQSITVRVEEWRLKQRDTEEWMRHRQLPHELRERVRRFIQYKWLATRGVNEESILQALPADLRRDIKRHLCLGLVRRVPFFSQMDDQLLDAICERLVSSLCTKGTYIVREGDPVTEMLFIIRGKLESSTTNGGRTGFFNSITLKPGDFCGEELLGWALVPKPTTNLPSSTRTVKALIEVEAFSLQAEDLKFVASQFRRLHSKKLQHTFRYYSHHWRTWASCFIQAAWRRYKRRKMAKDLSMRESFNSVRLDEVDEEDESPAKNSLALKFIARTRKVPQSTKELPKLRKPDEPDFSAEPDD

SEQ ID NO: 4175 - protein, 699 aa, Setaria italica
MDCDLFAAWWSSSTRLFSRIFRGSSDPPGPAPMKPAIPLHQKQAGLAASKLGVGTSKKHRAFVAGDEQWYKKIFDPSSDFILTWNRVFLVSCFAALFIDPLYFYVPKITYGSSVSCVGTDIHLAVIVTFLRSVADLLYVLHIIIKFRTAYINPSATLRVFGRGDLVTNPKEIAWKYLRSDFAVDVVAALPLPQIIIWFVIPAIKYSTSEHNNNILVLIVLAQYLPRLYLIFPLTYEIVKTTGVVAKTAWEGAAYNLVLYLIASHVLGALWYLLSVDRQTACWKKNCRDETGCDIKFLDCDDTPDSTWANTTTIFSNCNASNTSISFDFGMFLPALTNQAPAERFVMKYFYSLWWGLQNLSCYGQTLTVSTYLGETLYCIFLAVLGLVLFAHLIGNVQTYLQSITVRVEEWRLKQRDTEEWMRHRQLPHELRERVRRFIQYKWLATRGVNEESILQALPADLRRDIKRHLCLGLVRRVPFFSQMDDQLLDAICERLVSSLCTKGTHIVREGDPVTEMLFIIRGKLESSTTNGGRSGFFNSITLKPGDFCGEELLGWALAPKPTTNLPSSTRTVKALIEVEAFALQAEDLKFVANQFRRLHSKKLQHTFRYYSHHWRTWASCFIQAAWRRYKRRKMAKDLSMRESFNSVRLDEVDEEDESPPKNSLALKFIARTRKAPQRTKELPKLRKPDEPDFSAEPDD

SEQ ID NO: 4176 - protein, 682 aa, Oryza sativa
MALKRQRTVRFYDEKAKPTIPTHQKQAGFAASKLGVASSGKNKIFVPGEELWYKRILDPSSDFILTWNHIFLFSCFVALFIDPLYFYVPKISYGTPNSCIGTDRHLAITVTFFRSISDLLYFTHIIIKFRTAYINPSSTMRVFGRGDLITDPKEIAWQYLRSDFVVDAVAALPLPQILIWFVIPAIKYSTDEHNNNILVLIVLAQYFPRLYLIFPLTYEIVKTTGVVAKTAWQGAAYNMLLYMIASHVLGALWYLLSVDRQTACWKSNCKNETGCDIKFLDCDVIPNQNWASKTAIFNTCDATNTSISFDYGMFQPALFNQAPGQRFLMKYFYSLWWGLQNLSCYGQTITVSTYIGETLYCIFLAVLGLVLFAHLIGNVQTYLQSITVRVEEWRLKQRDTEEWMRHRQLPHELRERVRRFIQYKWLATRGVNEESILQALPADLRRDIKRHLCLGLVRRVPFFSQMDNQLLDAICERLVSSLCTQGTYIVREGDPVTEMLFIIRGKLESSTTNGGRTGFFNSTTLKSGDFCGEELLGWALVPKPTVNLPSSTRTVKALIEVEAFALQAEDLKFVANQFRRLHSKRLQHTFRYYSHHWRTWASCFIQAAWRRYKRRKMARDLSMRESFCSMRSDDSNGEDDSPPKQNLAMKIMSGSRKGPQNMKELPKLRKPDEPDFSAEPCE

SEQ ID NO: 4177 - protein, 685 aa, Secale cereale
MALGRQRTVRFYDERAKPAIPIQQKQAAFAASKLGVASSGKNRIFVGGDAQQNKIFDPSSDFILMWNRIFLFSCFLALFIDPLYFYVPKIVYGDTYSCVGTDTHLTIIITFFRSIADLLYVIHIIMKFRTAFVKTSSTLRVFGRGDLVTDPKEIAWKYLRSDFAIDVVAALPLPQIIIWYVIPAIKYSTAEHNNNILVLIVLAQYLPRLYLIFPLTYEIVKATGVVAKTAWEGAVYNLLLYLIASHVLGALWYLLSVDRQTACWKMSCRNETGCSIRYLDCDTPNQTWASTSSVFSKCNASDDKISFDYGMFQPALSNQAPAQGFLRKFFYSLWWGLQNLSCYGQTLSVSTYIGETLYCIFLAVLGLVLFAHLIGNVQTYLQSITVRVEEWRLKQRDTEEWMRHRQLPDELRERVRRFIQYKWLATRGVNEESILQVLPADLRRDIKRHLCLDLVRRVPFFSQMDDQLLDAICVRLVSSLCTKGTYIVREGDPVTEMLFIIRGKLESSTTNGGRTGFFNSTTLKAGDFCGEELLGWALVPKPTASLPSSTRTVKAQIEVEAFSLQAEDLKFVASQFRRLHSKKLQHTFRYYSHHWRTWGACFIQAAWRRYRRRKMAKDLSMRESFPSMRSEDSDGEDDPPPKKNISLRMMAGKVMAGNRKGLQAIKELPTLKKPDEPDFSVEPYE

SEQ ID NO: 4178 - protein, 331 aa, Sorghum bicolor
MSSNCGEEKELVCVTGAGGFIGSWVVKELLQRGYRVRGTARDPADSKNAHLLALDGAKERLTLCRADVLDRASLHAAFAGCNGVFHVASPVSNDPELVPVAVEGTRNVINAAADEGARRVVFTSSYGAVHMDPNRSPDAVLDETCWSDYDFCKRSDNLYCCAKMMAEITATEEAAARGLQLAVVLPCMTMGPMLQQTLNFSTNHVARYLMGTKRSIPNAVAAYVDVRDVARAHVLAYERPSACGRYLCIGTVLHREQLVAMLKELFPQYPVTAKCEDDGKPMAKPFKFSNQRLRDLGLEFTPLRKSLYETVVCLQQKGHLPVIQQQQRAYL

SEQ ID NO: 4179 - protein, 332 aa, Zea mays
MSSNCGEDEKELVCVTGAGGFIGSWVVNELLQRGYRVRGTARDPADSKNAHLLALEGAKERLTLCRADVLDRASLRAAFAGCHGVFHVASPVSNDPELVPVAVEGTRNVINAAADEGARRVVFTSSYGAVHMDPSRSPDAVLDETCWSDYDFCKRTDNLYCCAKMMAEVTAAAEADARGLQLAVVLPCMTTGPMLQQTLNFSTNHVARYLMGTKRSIPNAVAAYVDVRDVARAHVLAYERPGARGRYLCIGTVLHRADLVDMLRDLFPQYPVTAKCEEDGKPMAKPFKFSNQRLRDLGLEFTPLRKSLYETVLCLQQKGHLPVIQPQQRAYL

SEQ ID NO: 4180 - protein, 336 aa, Setaria italica
MSSYSKASNGEEQQQLVCVTGAGGFIGSWVVKELLLRGYRVRGTARDPADSKNAHLLALEGAKERLTLCRADVLDFDSLRAAFTGCHGVFHVASPVSNDPELVPVAVEGTRNVISAAADEGVRRVVFTSSYGAVHMDPNRSPDAILDETCWSDYDFCKQTDNLYCCAKMMAEITATEEAARRGLQLAVVVPCMTMGPMLQQTLNFSSNHVARYLMGTKRSYPNAVAAYVDVRDVARAHVLAFERPEARGRYLCIGTVLHRAQLIAMLRELFPQYPVTAKCEDDGKPMAKPYRFSNQRVKDLGMEFTPLKKSLYEAVVSMQKKGHLPVIREQQRAYL

SEQ ID NO: 4181 - protein, 334 aa, Panicum virgatum
MSSYSKPNNGEEQLVCVTGAGGFIGSWVVKELLLRGYRVRGTARDPADSKNAHLLALEGARERLTLCRADVLDYESLRAAFSGCHGVFHVASPVSNDPELVPVAVEGTRNVINAAADEGARRVVFTSSYGAVHMDPNRSPDAVLDETCWSDYEFCKRTDNLYCCAKMMAEITATEEAAARGLQLAVVVPCMTMGPMLQQTLNFSSNHVARYLMGTKRTYPNAVAAYVDVRDVARAHVLAYERPDARGRYLCIGTVLHRAQLIAMLRELFPQYPVTAKCEDDGKPMAKPFKFSNQRLKNLGLEFTPLKKSLYEAVVCMQQKGHLPVIREQQRAYL

SEQ ID NO: 4182 - protein, 333 aa, Panicum virgatum
MSSYSKASNGGGKLVCVTGAGGFIGSWVVKELLLRGYRVRGTARDPADSKNAHLLALEGAKERLTLCRADVLDYESLRAAFSGCHGVFHVASPVSNDPELVPVAVEGTRNAIDAAADEGVRRVVFTSSYGAVHMDPNRSPDAVLDETCWSDYEFCKQTDNLYCCAKMMAEITATEEAAARGLQLAVVVPCMTMGPMLQQALNFSSNHVARYLMGTKRSYPNAVAAYVDVRDVARAHVLAYERPGARGRYLCIGTVLHRAQLIAMLRELFPQYPVTAKCEDDGKPMAKPYKFSNQRLKDLGLEFTPLKKSLYEAVVCMQQKGHLPVIREQPAYL

SEQ ID NO: 4183 - protein, 356 aa, Pennisetum glaucum
MSSHPEASNGDEQQQQQLVCVTGAGGFIGSWVVKELLLRGYRVRGTARDPEDSKNAHLLALGGAEERLTLCRADLLDLDSLRAAFTGCHGVFHVASPVSNDPELVPVAVEGTRNVINAAAGEGVRRVVFTSSYGAVHMDPNRSPDAVLDETCWSDYDFCEKTDNLYCCAKMTAEITATEEAARRGLQLAVVVPCMTTGPMLQQALNFSSNHVARYLMGTKRTYPNAVAAYVDVRDVARAHVLAYERPGARGRYLCIGAVLHRSQLIAMLRDLFPQYPVTAKCEDDGTPMAKPYRFSNQRVKDLGLEFTPLKKSLYEAVVCMQKKGHLPVLRDVRTCKILGRWDFADEINRENEAKV

SEQ ID NO: 4184 - protein, 443 aa, Saccharum officinarum
MKTEASHKAIAAGGKMTVLHAPVGVRSIVTSLVAFFILASSIVFLFDKGQEERVQMAVEHGRQEVQLKLEAGLQEPAIRGTTEEGDTSNEECNWSRGRWVYDNVSRPLYNGLKCAFIFPEVACDKYGRKDVMYQHWRWQPHGCDLPRFDAIKLLEKLRNKRLVFVGDSVNRNQWVSLVCMVEASIPDDRLKIRIFNGSLISFKALEYNATIDFYWSPLLVESNSDNPIIHRVEYRIIRADRIEKHASVWRDADIIVFNSYLWWRKQKDDMRMKVMYGSFEDGDAKLDEMEMVDGFEIALKKLTEWLGENIDKNKTRIFFAGSSPTHSWASNWGGEDKNKCLNETEPIYKTGYKAATTDYSLMATAKSYFRTLEPKGIHVQILNITELSDYRKDGHPTVFRKQFAPLTKEQIAEPASYADCTHWCLPGVPDVWNEFLYGYLVHK

SEQ ID NO: 4185 - protein, 443 aa, Setaria italica
MKTESTHKTIAAGGKMTVPQSPVGVRSIVTSLVAFFILASSIVFLLDRGQEEQVQMAVEHGRQEVQVKVEAGLQEPAMRGTTEAEDTSNEECNWSRGQWVYDNVSRPLYSGLKCAFIFPEVACDKYGRKDVMYQHWRWKPHGCDLPRFNATRLLEKLRNKRLVFVGDSVNRNQWVSLVCMVEASIPDDRLKTRIFNGSLISFKALEYNATIDFYWSPLLVESNSDNPIIHRVEYRIIRADRIEKHASVWRDADIIVFNSYLWWRKQKDDMRMKVMYGSFEDGDARLDEMEMVDGFEIALKKLTEWLGENIDKNKTRIFFAGSSPTHSWASSWGGEDSNKCLNETEPIYKVGYKTATTDYSLMAKAKSYFRTLEPKGIHVQILNITELSDYRKDGHPTVFRRQFVPLTKEQIANPASYADCTHWCLPGVPDVWNEFLYGYLMYK

SEQ ID NO: 4186 - protein, 430 aa, Zea mays
MTVLHSPVGVRSIVTSLVAFFILASSIVFLLDRGQEEQVQVAVEHGRQEVQVKLESGLQEPAIRGTTQEGDASNEECNWSRGRWVYDNVSRPLYSGLKCSFIFPEVACDKYGRKDAMYQHWRWQPHGHGCDLPRFDAIKLLENLRNKRMVFVGDSVNRNQWVSLVCMVEASIPDDRLKIRTFNGSLISFKALEYNATIDFYWSPLLVESNSDNPIIHRVEYRIIRADRIEKHASVWRDADIIVFNSYLWWRKQKDDMRMKVMYGSFEDGDAKLDEMEMVDGFEIALKKLTEWLGENIDKNKTRIFFAGSSPTHSWASNWGGEDKNKCLNETEPIYKTGYKAATTDYSLMAKAKHYFRTLEPKGIHVQILNITELSDYRKDGHPTVYRKQFAPLTKEQIADPASYADCTHWCLPGVPDVWNEFLYGYLVQK

SEQ ID NO: 4187 - protein, 435 aa, Setaria italica
MKTEATPKMTVLHAPVGVRSIVSSLVAFFIVASSVTFLLDRGQEAQVQMAVEHGRQEMQVKVEAGLQEPAMRGTTESGDAGEECNWSRGRWVYDNVSRPLYSGLKCAFIFPEVACDKYGRKDVMYQHWRWQPQGCDLPRFNATRLLEKLRNKRLVFVGDSVNRNQWVSLVCMVEASIPDDRLKTRIFNGSLISFKALEYNATIDFYWSPLLVESNSDNPIIHRVEYRIIRADRIEKHASVWRDADIIVFNSYLWWRKQKDDMRMKVMYGSFEDGDARLDEMEMVDGFEIALKKLTEWLGENIDKNKTRIFFAGSSPTHSWASNWGGEDSNKCLNETEPIYKVGYKAATTDYSLMAKAKSYFRTLEPKGIHVQILNITELSDYRKDGHPTVFRRQFVPLTKEQIANPASYADCTHWCLPGVPDVWNEFLYGYLMYK

SEQ ID NO: 4188 - protein, 220 aa, Panicum virgatum
MKTETTPKMTVLHAPVGVRSIVSSLVAFFIVASSVTFLLDRGQEAQVQMAVEHGRQEMQVKLEAGLQEPAMRGTTDAGDAGEEECNWSRGRWVYDNMSRPLYSGLKCAFIFPEVACDKYGRKDVMYQHWRWQPHGCDLPRFDATKLLEKLRNKRLVFVGDSVNRNQWVSLVCMVEASIPDDRLKMRIFNGSLISFKALEYNATIDFYWSPLLVESNSDTP

SEQ ID NO: 4189 - protein, 435 aa, Panicum virgatum
MKTETTPKVMVLHAPVGVRSIVSSLVAFFIVASSVTFLLDRGQEAQVQMAVEHGRQEMQVKLEAGLQEPAMRGTTDAGDAGEECNWSRGRWVYDNMSRPLYSGLKCAFIFPEVACDKYGRKDVMYQHWRWQPHACDLPRFDATKLLEKLRNKRLVFVGDSVNRNQWVSLVCMVEASIPDDRLKMRIFNGSLISFKALEYNATIDFYWSPLLVESNSDNPIIHRVEYRIIRADRIERHANVWKDADIIVFNSYLWWRKQKDDMRMKVMYGSFEDGDARLDEMEMIDGFEIALKKLTEWLGENIDKNKTRIFFAGSSPTHSWASDWGGEDSNKCLNETEPIYKTGYKAATTDYSLMAKAKSYFKTLEPKGIHVQILNITELSDYRKDGHPTVFRRQFVPLTKEQIANPASYADCTHWCLPGVPDVWNEFLYGYLMYK

SEQ ID NO: 4190 - protein, 410 aa, Sorghum bicolor
MTVLHSPVGVRSIVTSLVAFFILASSIVFLLDRGQEQQVQMAVEHGRQEVQGDASNEECNWSRGRWVYDNVSRPLYNGLKCAFIFPEVACDKYGRKDVMYQHWRWQPHGCDLPRFDAIKLLEKLRNKRLVFVGDSVNRNQWVSLVCMVEASIPDDRLKIRIFNGSLISFKALEYNATIDFYWSPLLVESNSDNPIIHRVEYRIIRADRIEKHASVWRDADIIVFNSYLWWRKQKDDMRMKVMYGSFEDGDAKLDEMEMVDGFEIALKKLTEWLGENIDRNKTRIFFAGSSPTHSWASNWGGEDKNKCLNETEPIYKKGYKAATTDYSLMATAKSYFRTLEPKGIHVQILNITELSDYRKDGHPTVYRKQFVPLTKEQIADPASYADCTHWCLPGVPDVWNEFLYGYLVHK

SEQ ID NO: 4191 - protein, 408 aa, Saccharum officinarum
MTVLHAPVGVRSIVTSLVAFFILASSIVFLLDRGQEEQVQMAVRGTTEDGDASNEECNWSRGRWVYDNVSRPLYNGLKCAFIFPEVACDKYGRKDVMYQHWRWQPHGCDLPRFDAIKLLEKLRNKRLVFVGDSVNRNQWVSLMCMVEASIPDDRLKIRIFNGSLIFFRALEYNATIDFYWSPLLVESNSDNPIIHRVEYRIIRADRIEKHASVWRDADIIVFNSYLWWRKQKDDMRMKVMYGSFEDGDAKLDEMEMVDGFKIALKKLTEWLGENIDKNKTRIFFAGSSPDHSWASNWGGEDKNKCLNETEPIYKTGYKAATTDYSLMATAKSYFRTLEPKGIHVQILNITELSDYRKDGHPTVFRRQFVPLTKEQIADPASYADCTHWCLPGVPDVWNEFLYGYLVHK

SEQ ID NO: 4192 - protein, 407 aa, Sorghum bicolor
MTVLHAPVGVRSIVTSLVAFFILASSIVFLLDRGQEAQVQMAVERTEEEDASNEECNWSRGRWVYNNVSRPLYNGLKCAFIFPEVACDKYGRKDVMYQHWRWQPHGCDLPRFDAIKLLEKLRNKRLVFVGDSVNRNQWVSLVCMVEASIPDDRLKIRIFNGSLISFKALEYNATIDFYWSPLLVESNSDNPIIHRVEYRIIRADRIEKHASVWRDADIIVFNSYLWWRKQKDDMRMKVMYGSFEDGDAKLDEMEMVDGFEIAIKKLTEWLGENIDKNKTRIFFAGSSPTHSWASNWGGEDKNKCLNETEPIYKKGYKAATTDYSLMATAKSYFRTLEPKGIHVQILNITELSDYRKDGHPTVYRKQFVPLTKEQIADPASYADCTHWCLPGVPDVWNEFLYGYLVHK

SEQ ID NO: 4193 - protein, 437 aa, Pennisetum glaucum
MKTEATPKMTVLHAPVAVRSIVSSLVAFFIVASSVTFLLDGGQEARVQMAVEHGRQEMQLLKVEAGLQEPAMRGTTDAADAGEEECNWSRGRWVYDNMSRPLYSGLKCAFIFPEVACDKYGRKDVMYQHWRWQPQGCDLPRFNATRLLEKLRNKRLVFVGDSVNRNQWVSLVCMVEASIPDDRLKTRIYNGSLISFKALEYNATIDFYWSPLLVESNSDNPIIHRVEYRIIRADRIEKHASVWRDADILVFNSYLWWRKQKDDMRMKVMYGSFEDGDARIDEMEMVDGFEIAVKKLTEWLGENIDKNKTRIFFAGSSPEHSWASNWGGEDSNKCLNETEPVYKVGYKAATTDYSLMAKAKSYFETLEPKGIHVKILNITELSDYRKDGHPTVFRKQYVPLTKEQIANPASYADCTHWCLPGVPDVWNEFLYGYLMYK

SEQ ID NO: 4194 - protein, 421 aa, Setaria italica
MTILQTPVGARSIVTCLVAFFILASSIVFLLDKGQEVQMAVEHRHQQVQVKVEARLQEPAMGGATEVDTSEEDCNWSRGRWVYDNVSRPLYSGFKCAFIFREVACDKYGRKDVMYQHWRWQPHGCKLPRFDAIKLLEKLRNKRLVFVGDSVNRNQWVSLVCLVEASIPDDRLKMRVFNGSLISFKALEYNATIDFYWSPLLVESNSDNPIIHRVDYRIIRADRIEKHANVWRDADIIVFNSYLWWRKQRDDMTMKVMYGSFEDGDARLDEVEMTEGFEIALKKLTEWLGENIDKNKTRIFFVGSSPTHLRASKWGGEDSNKCLNETEPIYKDGYAAADYSLMAKAKSYFQTLEPKGIHVQILNITELSEYRKDGHPTVFRGQFVPLTKEQIANPASYADCTHWCLPGVPDVWNEFLYGYLI

SEQ ID NO: 4195 - protein, 414 aa, Zea mays
MAVLHSPVGVRSIVTSLVAFFILASSVVFLLLDREAGLQEEPAIRAGGGGGDEECSWSRGRWVYDNVSRPLYDGLKCAFIFPEVACDKYGRKDVMYQHWRWQPHGHGCDLPRFDAMKLLEELRNKRLVFVGDSVNRNQWVSLVCMVEASIPDDRLKMRIFNGSLISFKALEYNATIDFYWSPLLVESNSDNPIIHRVEYRIIRADRIEKHASVWRDADVIVFNSYLWWRKQKDDMRMKVMYGSFEDGDAKLDEMEMADGFEIAIKKLTEWLAKNIDKNKTRIFFAGSSPTHSWASNWGGQDKNKCLNETEPISYRPGGGYKAATTDYSLMAMARSYFRRTLEPRGIRVQILNITELSDYRKDGHPTVFRRQFVPLTKEQIADPASYADCTHWCLPGVPDVWNEFLYGYLTQQSK

SEQ ID NO: 4196 - protein, 423 aa, Panicum virgatum
MTVLHAPVGVRSIVSFLVAFFIVASSIVFLFDRGQEAQVQMVVDHGHQEVKEKAEAGLLGGSTEAADTSKEECNWSRGQWVYDNVSQPLYSGLKCTFIFPEVACEKYGRKDSMYQHWRWQPHGCDIPRFDAIRLLERLRNKRLVFVGDSVNRNQWVSLVCMVEASIPDDRLKTRIFNGSLISFKALEYNATIDFYWSPLLVESNSDNPIIHRVDYRIIRADRIEKHASVWRDADIIVFNSYLWWRKQNDDMRMKVMYGSFEDGDARLDEMEMMDGFEVAIKKLTEWLGEYIDKNKTRIFFAGSSPTHFRASNWGGEDSNKCLNETEPIYRVGYKSADYSLMAMAKSYFERLEAKGIHVEILNITELSDYRKDGHPTVFRKQYVALTKEQIAKPASYADCTHWCLPGVPDVWNQFLYGYLIMYK

SEQ ID NO: 4197 - protein, 382 aa, Sorghum bicolor
MRSPRGVGSGCYRGAGGQDQHVDLIPGIPDDVAVDCLARVPHASHRAMRRVCRGWRSAASTPAFASARAQADANEDIVYLMQFGNPSAAADDAEPKGDDGPANTPAYGVAVYNVTTGEWRRDRGAPPVVPVFAQCAAVGTRLAVLGGWDPRTFEPVADVHVLDAATGRWRRGAPMRSARSFFACAEAGGKIYVAGGHDKHKNALKTAEAYDPRADAWDPLPDMSEERDECDGMATVAGDRFLAVSGYRTARQGGFERDAEWFDPAARAWRRLERVRAPPSAAHVVVKGRVWCIEGNAVMEWMGTRRGWREVGPYPPGLKAGTARAVCVGGGEKVVVTGALDGEEGGGRHAVWVFDVKSKSWTVVRPPPEFAGFVFSVAAVRI

SEQ ID NO: 4198 - protein, 373 aa, Zea mays
MRAPRGGGGCRGGQEHVELIPGIPDDVAVDCLARVPHASHRAMRRVCRGWRSAAAAPAFASARAAAGANEDLVYLMQFGNPSGDDGPKDGDDGPGSTPAYGVAVYNVTTGEWRRERGAPPVVPVFAQCAAVGTRVAVLGGWDPRTFEPVADVHVLDAATGRWRRAAPMRSARSFFACAEAGGKIYVAGGHDKHKNALKTAEAYDAGADAWDPLPDMSEERDECDGMATVAGDRFLAVSGYRTARQGGFERDAEWFDPAARAWRRLDRVRAPPSAAHVVVRGRVWCIEGNAVMEWMGTRRGWREVGPYPPGLKAGTARAVCVGGGEKVVVTGALDGEGGRHALWVFDVKTKSWTVVRPPPEFAGFVFSVASVRI

SEQ ID NO: 4199 - protein, 371 aa, Zea mays
MRSPRGGGGLEHVDLIPGIPDDVAVDCLARVPHASHRAMRRVCRGWRSAAAAPAFASARAAAGANEDLVYLMQFGNPSADDGPKDGDEGPGNAPAYGVAVYNVTTGEWRRELGAPPVVPVFAQCAAVGTRLAVLGGWDPLTFEPVADVHVLDAATGRWRRGAPMRSARSFFACAEAGGRIYVAGGHDKHKNALKTAEAYDAEADAWDPLPDMSEERDECDGMATVAGDRFLAVSGYRTARQGGFERDAEWFDPAARAWRRLERVRAPPSAAHVVVRGRVWCIEGNAVMEWMGTRRGWREVGPYPPGLKAGTARAVCVGGGEKVVVTGALDGVGGGGRHALWVFDVRSKSWTVVPPPPEFAGFVFSVASVRI

SEQ ID NO: 4200 - protein, 375 aa, Setaria italica
MKNPRGVGGGRGGPMEHVDLIPGIPDDVAVDCLARVPHASYRALRRVCRGWRSAAAAPSFASARAAAGANEDLVYMLQFGNPSADDGPKDGDAPASTPAYGVAVYNVTTGEWRREPGAPPVVPVFAQCAAVGTRVAVLGGWDPRTFEPVADVHVLDAATGEWRHGAPMRSARSFFACAEAGGKIYVAGGHDKHKNALKTAEAYDAEADAWDPLPDMSEERDECDGMATVAGDRFLAVSGYRTARQGGFERDAEWFDPAARAWRRLERVRAPPSAAHVVVRGRVWCIEGNAMMEWMGTRRGWTEVGPYPPGLKAGTARAVCVGGGEKVVVTGALDGEGGGARHAVWVFDVKTKNWTVVRPPPEFAGFVFSVTSVRI

SEQ ID NO: 4201 - protein, 379 aa, Panicum virgatum
MRSPRGAAAAGRCGAQEHVDLIPGIPDDVAVDCLARVPHASHRALRRVCRGWRSAAAKPAFASARAAAGATEDLVYLLQFGNPSAADDDGAPKDGADAPPPSAPAYGVAVYNVTTGEWRRERGAPPVLPVFAQCAAVGTRVAVLGGWDPRTFEPVADVHVLDAATGAWRRAAPMRSARSFFACAEAGGKIYVAGGHDKHKNALKTAEAYDAGADAWDPLPDMSEERDECDGMATVAGDRFLAVSGYRTARQGGFERDAEWFDPAAREWRRLERVRAPPSAAHVVVRGRVWCIEGSAVMEWMGTRRGWREVGPYPPGLKAGTARAVCVGSGEKVVVTGALDGEGGRHALWVFDVRTKSWTVVRPPPEFAGFVFSVASVRI

SEQ ID NO: 4202 - protein, 377 aa, Panicum virgatum
MRSPRGGGRAHEHVDLIPGIPDDVAVDCLARVPHASHRALRRVCRGWRSAAAAPAFAAARAAAGANEDLVYMLQFGNPSAAADADDGGPKDCGAPPSAPAYGVAVYNVTTGEWLRERGAPPVLPVFAQCAAVGTRVAVLGGWDPRTFEPVADVHVLDAAKGAWRRAAPMRSARSFFACAEAGGKIYVAGGHDKHKNALKTAEAYDAVADAWDPLPDMSEERDECDGMATVAGDRFLAVSGYRTARQGGFERDAEWFDPAAREWRRLERVRAPPSAAHVVVRGRVWCIEGNAVMEWISPRRGWREVGPYPPGLKAGTARAVCVGGGEKVVVTGALDGEGGGGGRHALWVFEVKTKNWTLVRPPPEFAGFVFSVASVRI

SEQ ID NO: 4203 - protein, 383 aa, Oryza sativa
MRSPRSRALERDAGGVAVEHVELIPGMPDDVAVDCLARVPHGAHRAMRRVCRGWRSAAATPAFAMARAEAGANEDLVYLLQFANPAAAAAAAEEAKEDGDAPANSPAYGVAVYNVTTGEWRREKAAPPVPMFAQCAAVGTRLAVLGGWDPETFEPVADVHVLDASTGVWRSAPPMRSARSFFACAEAGGRIYVAGGHDKHKNALKTAEAYDAVADAWDPLPDMSEERDECDGMATVAGDRFLAVSGYRTARQGGFERDAEWFDPAARAWRRLDRVRAPPSAAHVVVRGRVWCIEGAAVMEWLGSRGGWREVGPSPPGLKAGTARAVCVGGGERVVVTGAIEDSDGGSGRHALWVFDVKTKNWTVVRPPPEFAGFAFSVAAVRI

SEQ ID NO: 4204 - protein, 196 aa, Zea mays
MTVIRLAAIRPPSASSSAASPSLWPPARLRLRVRCRAGGDGGMKKEEGEAEAPESLFARELRRRGMAPGAAAPAGASKEAEEGAPEAGAKRGVAATEFERGAAADGQRERSMALNSEGLEGLVPRAKLLLSLGSTFFLAFGPLILVTVSLFAVLYVYFGPSFVHDASKTPVSPPPYIDPYELLEDERLSRPSPDVF

SEQ ID NO: 4205 - protein, 89 aa, Sorghum bicolor
MKHIFKIAAILVAISAIWIALLETSTVPRSYTWLLPIYLVVALGCYGLFMVGFGLMFFPTCPQEAVLLQQDIVEAKEFLAKKGVDVGSE

SEQ ID NO: 4206 - protein, 89 aa, Panicum virgatum
MKHIFKIVAILVAISAIWVALLETSTVPRSYTWLLPIYLVVALGCYGLFMVGFGLMFFPTCPQEAILLQQDIVEAKEFLAKKGVDVGSE

SEQ ID NO: 4207 - protein, 89 aa, Zea mays
MKHIFKIAAILVAISAIWIALLETSTVPRSYTWLLPIYLVVALGCYGLFMVGFGLMFFPTCPREAVLLQQDIVEAKEFLGKRGVDVGSE

SEQ ID NO: 4208 - protein, 89 aa, Setaria italica
MKHIFKIVAILVAISSIWIALLETSTIPRSYTWLLPIYLVVALGCYGLFMVGFGLMFFPTCPQEAILLQQDIVEAKEFLAKKGVDVGSE

SEQ ID NO: 4209 - protein, 89 aa, Pennisetum glaucum
MKHIFKIIAILVAISAIWVALLETSTVPRSYTWLLPIYLVVALGCYGLFMVGFGLMFFPTCPQEALLLQQDVVEAKEFLAKKGVDVGSE

SEQ ID NO: 4210 - protein, 89 aa, Panicum virgatum
MKHISKIVAILVAISAIWVALLETSTVPRSYTWLLPVYLVVALGCYGLFMVGFGLMFFPTCPQEAILLQQDIVEAKEFLAKKGVDVGSE

SEQ ID NO: 4211 - protein, 89 aa, Panicum virgatum
MKHIFKIVAILVAISAIWVTFLETSTVPRSYTWLLPIYLVVALGCYGLFMVGFGLMFFPTCPQEAILLQQDIVEAKEFLAKKGVDVGSE

SEQ ID NO: 4212 - protein, 89 aa, Brachypodium distachyon
MKHIFKIIAVLVAISAFWVALLETSTVPRSYTWLLPIYLVVALGCYGLFMVGFGLMFFPTCPQEAILLQQDIVEAKEFLAKKGVDVGSE

SEQ ID NO: 4213 - protein, 89 aa, Oryza sativa
MKHIFKIIAMLVAVSAIWIALLETATVPRSYTWLLPIYLVVALGCYGLFMVGFGLMFFPTCPQEAVLLQQDILEAKEFLSKKGVDVGSE

SEQ ID NO: 4214 - protein, 85 aa, Cenchrus ciliaris
MKHIFKIVAILVAISAIWVALLETSTVPRSYTWLLPIYLVMALGCYGLFMVGFGLMFFPTCPQEALLLQQDIVEAKEFLAKKGVD

SEQ ID NO: 4215 - protein, 89 aa, Hordeum vulgare
MKHIFKIIAVLAAISAVWVALLETSTVPRSYTWLLPIYLVVALGCYGLFMVGYGLMFFPTCPQEAVLLQQDIVEAKEFLSKRGVDVSSD

SEQ ID NO: 4216 - protein, 89 aa, Pseudoroegneria spicata
MKHIFKIIAVLAAISAIWVALLETSTVPRSFTWLLPIYLVVALGCYGLFMVGYGLMFFPTCPQEAVLLQQDIVEAKEFLSKRGVDVSSD

SEQ ID NO: 4217 - protein, 88 aa, Festuca arundinacea
MKHIYKIIAVLAAITAVWVALLETSTVPRSYAWLLPIYLVVALGCYGLFMVGYGLMFFPTCPQEAVLLQQDIAEAKEFLAKKGVDVGS

SEQ ID NO: 4218 - protein, 89 aa, Unknown
  Sequence found in Organisms: Secale cereale, Triticum aestivum
MKHIFKIIAVLAAISAVWVALLETSTVPRSFTWLLPIYLVVALGCYGLFMVGYGLMFFPTCPQEAVLLQQDIVEAKEFLSKRGVDVSSD

SEQ ID NO: 4219 - protein, 89 aa, Triticum aestivum
MKHIFKIITVLAAISAVWAALLETSTVPHSYTWLLPIYLVVALGCYGLFMVGYGLMFFPTCPQEAILLQQDIMEAKEFLSKRGVDVGSD

SEQ ID NO: 4220 - protein, 80 aa, Saccharum officinarum
MALDARSLPTVVSVPALEVCSGMPRTGNGGGVSSATAGAAEVSVVDVPALWTDEGRMKRELVAWAKAVASMAIRETMMQC

SEQ ID NO: 4221 - protein, 299 aa, Panicum virgatum
MAVEIPLIDLRLAGAAPEESARLRAACERLGCFRVTGHGVPGGLLAEMKAAVRALFDLPDDAKRRNADVIPGSGYVAPSAANPLYEAFGLLDAAAPADVDAFCARLDAPPHLRETVKAYAEKMHDVIVDVAGKLASSLGLAEHSFEDWPCQFRINRYNYTQDTVGSSGVQTHTDSGFLTVLQEDECVGGLEVLDPATGEYVPVDPVAGSFLVNIGDVGTAWSNGRLHNVKHRVRCVAPVPRISVAMFLLAPKDDRVSAPEAFVDADHPRRYREFNYDDYRRLRLSTGERAGEALARLAA

SEQ ID NO: 4222 - protein, 299 aa, Panicum virgatum
MAVEIPVIDLRLAGAAPEESARLRAACERLGCFRVTGHGVPGGLLAEMKAAVRALFDLPDDAKRRNADVIPGSGYVAPSAANPLYEAFGLLDAAAPADVDAFCARLDAPPHLRETVKAYAEKMHDVIVDVAGVLASSLGLAEHSFKDWPCQFRINRYNYTQDTVGSSGVQTHTDSGFLTVLQEDECVGGLEVLDPATCEYVPVDPVAGSFLVNIGDVGTAWSNGRLHNVKHRVRCVAPVPRISVAMFLLAPKDDRVSAPEAFVDADHPRRYREFNYDDYRRLRLSTGERAGEALARLAA

SEQ ID NO: 4223 - protein, 300 aa, Zea mays
MAEIPVIDLRLAGSSPDESARLRDACERLGCFRVTGHGAPAGLLADMKAAVRALFDLPDDAKRRNADVIPGSGYVAPCPANPLYEAFGLLDAAAPADVDAFCARLDAPPKVRETVKTYAEKMHDVIVGVAGELATSLGLGLEEHSFQDWPCQFRINRYNYTQETVGSSGVQTHTDSGFLTVLQEDECVGGLEVLDPAAGEFVPVDPVAGSFLVNIGDVGTAWSNGRLHNVKHRVRCVAPVPRISIAMFLLAPKDDRVSAPEALVDAGHPRRYKPFNYDDYRRLRLSTGERAGEALARMAA

SEQ ID NO: 4224 - protein, 299 aa, Saccharum officinarum
MAEIPVIDLRLAGSSPEESARLRAACERLGCFRVTGHGVPAALLAEMKAAVRALFDLPDDAKRRNADVIAGSGYVAPSPTNPLYEAFGLLDAAAPADVDAFCTLLDAPPHVRETVKTYAEKMHDVIVGVAGELASSLGLVEEHSFQDWPCQFRINRYNYTRETVGSSGVQTHTDSGFLTVLQEDERVGGLEVLDPATGDFVPVDPVAGSFLVNIGDVGTAWSNGRLHNVKHRVRCVAPVPRISIAMFLLAPKDDSVSAPESFVDADHPRRYKAFTYGDYRRLRLSTGEHAGEALARMAA

SEQ ID NO: 4225 - protein, 301 aa, Sorghum bicolor
MAEIPVIDLRLAGSAAEESARLRAACERLGCFRVTGHGVPAGLLAEMKAAVRALFDLPDDAKRRNADVIPGSGYMAPSPTNPLYEAFGLLDAAAPADVDAFCALLDAPPHVRETIKTYAEKMHDVIVAVAGELASSLGLVAEEHSFQDWPCQFRINRYNYTHETVVGSSGVQIHTDSGFLTVLQEDERVGGLEVLDPATGEFVPVDPVAGSFLVNIGDVGTAWSNGRLHNVKHRVRCVAPVPRISIAMFLLAPKDDGVSAPEAFVDADHPRRYKAFTYGDYRKLRLSTGEHAGEALARMAA

SEQ ID NO: 4226 - protein, 299 aa, Zea mays
MAEIPVIDLRVAGSAAEESARLRAACERLGCFRVTGHGVPSVLLAEMKAAVRALFDLPDDAKRRNADVITGSGYVAPSPTNPLYEAFGLLDAAVPTDVDAFCALLDAPPNIRETVKAYAEKMHDVIVGVARELASSLGLVEEHSFQDWPCQFRINRYNYTRETVGSSGVQTHTDSGFLTVLHEDECVGGLEVLDPGTGEFVPVDPVAGSFLVNIGDVGTAWSNGRLHNVKHRVRCVAPVPRISIAMFLLAPKDDSVSAPAAFVDADHPRRYKVFNYNDYRRLRLSTGEHAGEALARMAA

SEQ ID NO: 4227 - protein, 299 aa, Panicum virgatum
MAAEVPVIDLRLAGAAPEEAARLRAACERLGCFRVTGHGVPRGLLAEMKVAVRALFDLPDDAKRRNTDVIPGSGYVPPSATNPLYEAFGLLDAAAPADVDAFCARLDAPPHVRETVKAYAEKMHDVIVGVAGVLASSLGLEEHSFRDWPCQFRINRYNYTQGTVGSSGVQIHTDSSFLTVLQEDECVGGLEVSDPATGEFVPVDPVAGSFLINIGDIGTVWSNGRLHNVKHRVRCVAPVPRISIAMFLLGPKDGRVSAPEPFVDADHPRRYKEFNYGDYRGLRLSTGEHAGEALARLEA

SEQ ID NO: 4228 - protein, 299 aa, Panicum virgatum
MAAEVPVIDLRLAGAAPEEAARLRAACERLGCFRVTGHGVPRGLLAEMKVAVRALFDLPDDAKRRNTDVIPGSGYVPPSATNPLYEAFGLLDAAAPADVDAFCARLDAPPHVRDTVKAYAEKMHDVIVGVAGVLASSLGLEEHSFRDWPCQFRINRYNYTQGTVGSSGVQIHTDSSFLTVLQEDECVGGLEVSDPATGEFVPVDPVAGSFLINIGDIGTVWSNGRLHNVKHRVRCVAPVPRISIAMFLLGPKDGRVSAPEPFVDADHPRRYKEFNYGDYRGLRLSTGEHAGEALARLEA

SEQ ID NO: 4229 - protein, 301 aa, Setaria italica
MAAAAEVPVIDLRLAGSASEESARLRAACERQGCFRVTGHGVPRGLLAEMKAAVRALFDLPDDAKRRNTDVIPGSGYVAPSATNPLYEAFGLIDAAAPADVDAFCACLDAPPHLRATVKSYAERMHDVIVDVAGKLASSLGLEEHSFGDWPCQFRINRYNYTEDTVGSPGVQTHTDSGFLTVLQEDECVGGLEVLDPATGEFVPVDPVAGSFLINIGDVGTAWSNGRLHNVRHRVQCVAPVPRFSIAMFLLAPKDDRVSAPEAFVDADHPRRYREFKYDDYRRLRLSTGERAGEALARLAV

SEQ ID NO: 4230 - protein, 299 aa, Pennisetum glaucum
MAVEIPVVDLRLAGASPEESARLRAACERIGCVRVTGHGVAPELLAEMKATVRALFDLPDDAKRRNADVIPGSGYVAPSVANPLYEAFGLLDAAAPADVDAFCARLDAPPHLRATVKNYAERMHDVIVDVAGKLASSLGLEEHSFGDWPCQFRINRYNYTEDTVGSPGVQTHTDSGFLTVLQEDECVGGLEVLDPATGEFVPVDPVAGSFLINIGDVGTAWSNGRLHNVRHRVQCVAPMPRFSIAMFLLAPKDDMVSAPEAFVDAGHPRRYREFKYDDYRKLRLSTGERAGEALARLAA

SEQ ID NO: 4231 - protein, 301 aa, Setaria italica
MAAAAEVPVIDLRLAGSASEESARLRAACERQGCFRVTGHGVPRGLLAEMKAAVRALFDLPDDAKRRNTDVIPGSGYVAPSATNPLYEAFGLIDAAAPADVDAFCACLDAPPHLRATVKSYAERMHDVIVDVAGKLASSLGLEEHSFGDWPCQFRINRYNYTKDTVGSSGVQIHTDSSFLTVLQEDECVGGLEVLDPAAGEFVPVDPVAGSFLVNIGDVGTVWSNGRLHNVRHRVRCVAPVPRISIAMFLLGPKDGRVSTPEAFVDAGRPRRYKEFNYDDLRRLRLSTGEHAGEALARLEA

SEQ ID NO: 4232 - protein, 298 aa, Leymus cinereus x Leymus triticoides
MAEIPAIDLRLAGARPEESARLRDACERLGCFRVSGHGVPAALQAEMKAAVRALFDLPDEAKRRNTDIIAGSGYVAPSPANPLYEAFGLLDAAAPADVDAFCARLDAPPRARETVKSYAEAMHELIVDVAGKVAASLGLEGHPFQDWPCQFRMNRYDYTQDTVGSSGVQIHTDSGFLTVLQEDDCVGGLEVLDPATGEFVRVDPVPGSFLVNIGDVGTAWSNGRLHTVKHRVQCVAAVPRISIAMFLLAPKDDRVCAPEAFVDAEHPRRFKAFNYDDYRKLRLSTGERAGEALARMAA

SEQ ID NO: 4233 - protein, 298 aa, Triticum aestivum
MVEIPVVDLRLAGAQPEESARLRDACERLGCFRVSGHGVPAALQAEMKAAVRALFDLPDEAKRRNADIIAGSGYVAPSPANPLYEAFGLLDAADPADVDAFCARLDAPPRARETVKSYAEAMHELIVDVAGKVAASLGLEGHPFQDWPCQFRINRYNYTEDTVGSSGVQIHTDSGFLTVLQEDDCVGGLEVLDPATGEFVRVDPVPGSFLVNIGDVGTAWSNGRLHTVKHRVQCVAAVPRISIAMFLLAPKDDRVCAPEAFVDAQHPRRFKAFNYDDYRKLRLSTGERAGEALARMAA

SEQ ID NO: 4234 - protein, 227 aa, Secale cereale
MVEIPAIDLRLAGARPEELARLRDACERLGCFRVSGHGVPAALQAEMKAAVRALFDLPDEAKRRNADIIAGSGYVAPSPANPLYEAFGLLDAAAPADVDAFCARLDAPPRARETVKSYAEAMHELIVDVAGKVAASLGLEGHPFQDWPCQFRINRYNYTKDTVGSSGVQIHTDSGFLTVLQEDDCVGGLEVLDPSTGDFVRVDPVPAHSSSTSATSARRGATGGCTP

SEQ ID NO: 4235 - protein, 298 aa, Brachypodium distachyon
MVEIPVIDLRLAGAAPEESARLRDACERLGCFRVFGHGVPAALQADMKAALRALFDLPDDAKRRNTEIIAGSGYVPPSAANPLYEAFGLWDAAVPADVDAFCARLDAPPHAREAVKSYAEKMHELIVDVAGKVAASLGLEGHPFQDWPCQFRMNRYNYTEDTVGSSGVQIHTDSGFLTVLQEDDCVGGLEVLDPAAGEFVPVDPFPGSFLVNIGDVGTAWSNGRLHSVKHRVQCVAAVPRISIAMFLLAPKDDRVCTPEAFVDADHPRRYRAFNYDEYRKLRLSTGERAGEALARMAA

SEQ ID NO: 4236 - protein, 300 aa, Oryza sativa
MVEIPAIDLRLAGGGGGAEETARLRDACARLGCFRVSGHGVPPGLQAEMKAAVRALFDLPDDAKRRNADIIPGSGYVPPGTANPLYEAFGLCDAAAPADVDAFCARLDAPPHVRETVKAYAERMHSLIVDVAGKVAASLGLHGASFQDWPCQFRMNRYNYTQDSVGSPGVQVHTDSGFLTVLQEDECVGGLEVLDPAAGEFVPVDPLPGSFVVNVGDVGQAWSNGRLHNVKHRVQCVAAVPRVSIAMFLLAPKDDTVSAPGELVDGEHPRRYREFKYDDYRRLRLSTGERAGEALARLAA

SEQ ID NO: 4237 - protein, 318 aa, Panicum virgatum
MMTELMRVASAQLMARHGQATTVPVIDLRLAGAAPEEDACERLGCFRVTGHGVPGGLLAEMKAAVRALFDLPDDAKRRNADVIPGSGYVVPSATNPLYEAFGLLDAAAPADQILLASDVDAFCARLDAPPRVRETVKAYAEKMHDVIVDVAGVLASSLGLEEHSFRDWPCQFRINRYNYTQDTVGSSGVQIHTDSSFLTVLQEDECVGGLEVSDPATGEFVPVDPVAGSFLINIGDIGTQREAAQREAPGAVRCVAPVPRISIAMFLLGPKDGSVSAPEPFVDADHPRRYKEISYGDYRALRLSTGEHAGEALARLEA

SEQ ID NO: 4238 - protein, 348 aa, Zea mays
MARPRGKKRTAPRAAATDSVQPEAAATETAAAEPANRGRWKRVKAPPKPKPETDYFAEKRNLEDLWLSAFPVGTEWENIDKIKEFNWSFENLEKALEEGGELHGKTVYLFGSTEPQLLDVNGESKIVLIPIVVAVDCPFPPSDKIGINSVQRENEEIVPMKAMKMAWVPYVPLEDRLSRIDSLKTKIFTLGCTQRRSALKHLKIERVKKFDYCMPYYMPLQPLEDENDTVISFLYPLEPPIVDEFDWEMDDYEDFADQKVQEGGLPEDEKEKFKEFLKEKVRERKRELKQAKEARRKAIDDMDPKVKEAFENIKFYKFYPVKTPDTPDVNNVKARYINRYYRNAHYLM

SEQ ID NO: 4239 - protein, 353 aa, Zea mays
MARPRAKKRTTPQAAATDSVEPDATVGASSKLEEAAAEPATRERGKRVKAPPKPKPETEYFDEKGNFEDLWLSAFPVGTEWENIDKIKEFNWSFENVEEALEEGGELHGKTLYMFGSTEPQLLYVNGESKIVLIPIVVAVDCPFPPSDKIGINSVQRENEEIVPMKAMKMAWVPYVPLEDRLSRIDIFKTKIFTLGCTQRRSALKHLKIERVKKFDYCMPYYMPLQPLEDEENTTINFLYPLEPPIVDEFDWEMDDYEDFADQKVQEGSLPEGEKEKFKEFLKEKVRERKRELRQAKEARKKAIDDMDPAMKEAFENIKFYKFYPVKTPDTPDVNNVKARYINRYYRNAHYLK

SEQ ID NO: 4240 - protein, 354 aa, Sorghum bicolor
MARPRGKKRTATQAAATGSVEPEAAAGAPSKPEASAATEPATRGRGKRVKAPPRPKPEPEYFPEKRNLEDLWLSAFPVGTEWEHIDKVKEFNWSFENLEKALEEAGELHGKTVYMFGSTEPQLLDVNGESKMVFIPVVVAVDCPLPPSDKIGINSVQRENEEIVPMKAMKMAWVPYVPLEDRLSRIDSLKTKIFTLTCTQRRSALKHLKIERVKKFDYCMPYYMPLQPLEDENDTVINFVYPLEPPIVDEFDWEMDDYKGFADQKVEEGWLPEGEKEKFKEFLKEKVRERKRELKQAKEARKKAIDDMDPKMKEAFENIKFYKFYPVKTPDTPDVNKEKARYINRYYMHAHYVM

SEQ ID NO: 4241 - protein, 354 aa, Setaria italica
MARPRGKKRTAAQAAATDSSKPGAAAAGDSTKPEAAAKEPAARGRGRRPKAPPKPKAETEYFPEKRNLEDLWLSAFPIGTEWENIDKIKEFNWNFENLEKTLEEGGELYGKTVYLFGSTEPQLLDVNGESKIVLIPVVVAVDCPFPPSDKIGINSVQRENEEIVPMKAMKMAWVPYVPLEDRLSRIDSLKTKIFTLGCTQRRSALKHLKTERVKKFDYCMPYYMPLNPPEDEDDTVVNIIYPLEPPIVCDFDWEMDDYEDFIEEKVKDEVLPEDEKEKFKEFLKEKVRERKRELKQAKEARKKAIDDMDPKTREAFENIKFYKFYPVKTPDTPDVSNVKAKYINRYYRNAHYLM

SEQ ID NO: 4242 - protein, 348 aa, Panicum virgatum
MARPRGKKRTAPQAAPTDSSKPKDAAGDSTKPEPAARGRGKRAKAPPKPKAETEYFPEKRNLEDLWLSAFPIGTEWENIDKIKEFNWNFENLEKTLEEGGELYGKTVYLFGSTEPQLLDVNGESKIILIPIVVAVDCPFPPSDKIGINSVQRENEEIVPMKAMKMAWVPYVPLEDRLSRIDSLKTKIFTLGCTQRRSALKHLKTERVKKFDYCMPYYMPLNPPEDEDDTVVNIIYPLEPPIVCDFDWEMDDYEDFADEKVKDEVLPEDEKEKFKEFLKEKVRERKRELKQAKEARKKAIDDMDPKTREAFENIKFYKFYPVKTPDTPDVTNVKAKYINRYYRNAHYLM

SEQ ID NO: 4243 - protein, 354 aa, Panicum virgatum
MVRPRGKKRTAAQAAATDSSKPKADAGDSTKPEAAAAKDPAVRGRGNRAKAAPKPKAETEYFPEKRNMEDLWLSAFPIGTEWENIDKIKEFNWNFENLEKALEEGGDLYGKIVYLFGSTEPQLLDVNGESKIVLIPIVVAVDCPFPPSDKIGINSVQRENEEIVPMKDMKMAWVPYVPLEDRLSRIDNLKTKIFTLGCTQRRSALKHLKTERVKKFDYCMPYYMPLNPPEDEDDTVVNIIYPLEPPIVCDFDWEMDDYEDFADEKVKDEVLPEDEKEKFKEFLKEKVRERKRELKQAKEARKKAIDDMDPKTREAFENIKFHKFYPVKTPDTPDVTNVKAKYINRYYRNAHYLM

SEQ ID NO: 4244 - protein, 340 aa, Setaria italica
MARPRGKKRTAAEAAATDSSKPEAAAKEPAKRGRAKRVKAPAEPTEYFPEKRNLEDLWLSAFPVGTEWENIDKIKEFNWNFENLEKTLEEGGELYGKTVYLFGSTEPQLLYVNGESKIVLIPVIIAVDCPFPPSDKIGINSVQRENEEIVPMKAMKMAWVPYVPLEDRLSRIDSLKTKIFTLGCTQRRSALKHLKTERVKKFDYCMPYYMPLQPVEDEDDTVINFLYPQEPPIVDDFDWEMDEYEDFADQKVKDEVLPEDEKEKFKEFLKEKVRERKRELKQAKEARKKAIDDMDPKEKEAFENIKFYKFYPVKNPDTPDVDNVKSKYINRYYRHTHYLM

SEQ ID NO: 4245 - protein, 346 aa, Oryza sativa
MARPRGRKRAAAAAAVAEEDSSKPEAAEAKKPAARGRGKRAKASPKPKPETEYFPEKRNLEDLWLSAFPVGTEWENIDKIKEFNWNFENLEKALEEGGELYGKTVYLFGSTEPQLLEVNGESKIVLIPIVVAVDCPFPPSDKIGINSVQRENEEIVPMKAMKMAWVPYVPLEDRLSRIDSLKTKIFTLGCTQRRSALRHLKTERVKLFDYCMPYYMPLNPPEDEDDTVVNIIYPLEPPIVCDFDWEMDDYEDFADEKVKDEVLPEDEKEKFKEFIKERVRERKRELKQAKEARKKAIDDMDPKVKEAFENIKFYKFYPVKTPDTPDVSNVKAKYINRYYRHAHHLM

SEQ ID NO: 4246 - protein, 113 aa, Secale cereale
MAPAKGKKRAAAAAGDSQAAAAANGGRPKRTKAPPKPKPETEYFPEQRNLEDLWLSAFPIGTEWENIDKIKEFNWNFENLEKALEEGGNCMGRQSMYLAALSLNYWMLTVNQR

SEQ ID NO: 4247 - protein, 711 aa, Zea mays
MVLGGGPLGAIIGRYPSSSAAAGDDEQGDPGPGGGVIRHDRKCRDWPFLVLFAAFWVAMIVNSSFGFNQGNPLRLTYGLDYKGNICGSRHADPDLYQLDVRYWVNPNQVYQSGLKTSHIELPDAKTICLMECPLPAEDGLNFVCDYPEGDIRLSVDDWIDRDYDYFEYLTPDMRNSSLQLQGPCYPVIFPSVNVYWSCQFIARASNASLKHWKDMGGVTIDENMLIDRTIHDAINSKSAVMKRYVADIGKSWPVLILCGGLLPLFLSMIWLLMIRFFVAGMSWITVVVFNALVVSVTMFFYIKAGWIGHDPLTVVIGESDPYVSIGGREINHLHAASVLMTVIMILAFLTSIAIARRIMKATSVLKVAAKVVGEVQALIIFPVVPYLILAIFYTFWFSAALHLFSAGQVIQNDCNTDCCSYDLKLGKVNCDRCCGYTIHYTPHIGIAILFHLFGCYWATQFFIGCSSTIIAGSVASYYWARGEISHDIPFHTVVSSLKRLLRYSLGSVALGSLIVSIVEWVRFILESLRRRLKFVDSARGSRFGKTVSSSSQCCLGCIDWTLKSVNRNAYVMIAITGKGFCKASVLATGLIMNNVLRVGKVNVIGDVILLLGKLCVSLLCALFAFLMLDEHKYRSGHNKISSPLVPVLLSWALGYIVAKLFFAVVEVSIDTMVLSFCQDSEEHQGNARYAPPLLMETLDEESELRRLTQGP

SEQ ID NO: 4248 - protein, 701 aa, Setaria italica
MALGGGPLGAIIGRYPSAADEQDPGGGVIRHDRKCRDWPFLLLFAAFWVAMIVNSSFGFNQGNPLRLTFGLDYKGNICGSKHAVPDLRELDVRYWMNPNQVYQSGLKSSRINLPDVKAICLMECPLPAEDGLNFVCDYPEGDIRLSVDDWIDRDYDYFEYLTPDMRNSSLQLQGPCYPVIFPSVNVYWSCQFIARASNVSLKHWQQMGGVSIDENMLIDKTIHNTINSKSAVLKRYVADIGKSWPVLIVCGGLLPLFLSGIWLLMIRFFVAGMPWITVVVFNALVISVTMFFYIKAGWIGHDPLTVVIGESDPYVNIGGREINHLHAASVLMTVIMILAFLTSIAIARRIATSVLKVAAKVIGEVQALIVFPAVPFLILAIFYIFWFSATLHLFSAGQVIRNDCNTDCCSYDLKLGKVNCDSCCGYSIHYTPHIGIAILFHFLGCYWATQFFIGCSSTVIAGSVASYYWARGEISHDVPFRTVVSSLKRLLRYSLGSVALGSLIVSIVEWVRFILESLRRRLKFVNSAHDSWFGKTASSSSQCCLGCIDWTLKSVNRNAYIMIAITGKGFCKASALATELIMKNILRIGKVNVIGDVILMLGKLCVSLFCALFAFIMLDKHKYRSGHNKISSPLVPVLVSWALGYIVAKLFFAVVEMSIDTIMLSFCQDTEEHEGNARYAPPLLMETLDEESELRRLTEGP

SEQ ID NO: 4249 - protein, 705 aa, Panicum virgatum
MALGGGPLGAIIGRYPSFAAADDQDPGGGVIRHDRKCRDWPFLLLFAAFWVAMIVNSSFGFNQGNPLRLTFGLDYKGNICGSRHGDPDLRELDVRYWMNPNQVYQSGLKSSHIDLPDAKAICLMECPLPAEDGLNFVCDYPEGDIRLSIDDWIDRDYDYFEFLTPDMRNSSLQLQGPCYPVIFPSVNVYWSCQFIARASNVSLKHWQQMGGVSIDENMLIDKTIHNAINSKSAVLKRYVADIGKSWPVLLLCGGFLPLVLSVIWLLMIRYFVAGMPWITVVVFNALVISVTMFFYIKAGWIGHDPLTVVIGESDPYVNIGGREINHLHAASVLMTIVMILAFLTSIAIARRILVATSVLKVAAKVIGEVHALISFPTVPFLILAIFYIFWFSATLHLFSAGQVIRNDCNTDCCSYDLKLGKVNCDSCCGYSIHYTPHIGIAILFHFFGCYWATQFFIGCSSTVIAGSIASYYWARGEVSHDIPFRTVVSSLKRMVCYSLGSVALGSLIVSIIEWLRFILETLRRRLKFVDSAHDSWFGKTVSSSSQCCLGCIDWTLKSVNRNAYIMIAITGKGFFKASALATGLIIKNVLRIGKVNVIGDVILMLGKLCVSLLCALFAFIMLDKHKYRSGHNKISSPLVPVLVSWALGYIVAKLFFAVVEMSIDTIILSFCQDTEEHQGNAQYAPPLLMETLDEESELQRLTEGP

SEQ ID NO: 4250 - protein, 439 aa, Panicum virgatum
MIRYFVAGMPWITVVVFNALVISVTMFFYIKAGWIGHDPLTVVIGESDPYVNVGGREINHLHAASVLMTIVMILAFLTSIAIARRILVATSVLKVAAKVIGEVHALISFPVVPFLILAIFYIFWFLATLHLFSAGQVIRNDCNTDCCSYDLKLGKVNCDSCCGYSIRYTPHIGIAILFHFLGCYWATQFLIGCSSTIIAGSVASYYWARGEVSHDIPFRTVVSSLRRTMRYSLGSVALGSLIVSIVEWVRFILETLRRRLKFVNSAHDSWFGKTVSSSSQCCLGCIDWTLKSVNRNAYIMIAITGKGFFKASALATGLIMKNVLRIGKVNVIGDVILMLGKLCVSLLSALFAFIMLDKHKYRSGHNKISSPLVPVLVSWALGYVVAKLFFAVVEMSIDTIILSFCQDTEEHQGNAQYAPPLLMETLDEESELQRLTEGP

SEQ ID NO: 4251 - protein, 717 aa, Panicum virgatum
REREREREGENQNGLGGGPLGAIIGRYPSFAAADDQDPGGGVIRHDRKCRDWPFLLLFAAFWVAMIVNSSFGFNQGNPLRLTFGLDYKGNICGSRHADPDLHELDVRYWMNPNQVYQSGLKSSHINLPDAKAICLMECPLPAEDGLNFVCDYPEGDIRLSVDDWIDRDYDYFEFLTPDMRNSSLQLQGPCYPVIFPSVNVYWSCQFIARASNVSLKHWQQMGGVSIDENMLIDKTIHNAINSKSAVLKRYVADIGKSWPVLLLCGGFLPLVLSVIWLLMIRYFVAGMPWITVVVFNALVISVTMFFYIKAGWIGHDPLTVVIGESDPYVNIGGREINHLHAASVLMTIIMILAFLTSIAIARRILVATSVLKVAAKVIGEVHALISFPVVPFLILAIFYIFWFLATLHLFSAGQVIRNDCNTDCCSYDLKLGKVNCDSCCGYSIRYTPHIGIAILFHFLGCYWATQFLIGCSSTIIAGSVASYYWARGEVSHDIPFRTVVSSLRRTMRYSLGSVALGSLIVSIVEWVRFILETLRRRLKFVNSAHDSWFRKTVSSSSQCCLGCIDWTLKSVNRNAYIMIAITGKGFFKASALATGLIMKNVLRIGKVNVIGDVILMLGKLCVSLLSALFAFIMLDKHKYRSGHNKISSPLVPVLVSWALGYVVAKLFFAVVEMSIDTIILSFCQDTEEHQGNAQYAPPLLMETLDEESELQRLTEGP

SEQ ID NO: 4252 - protein, 711 aa, Oryza sativa
MGGPLGAIIGRHPAAAGGGGGDELGGVGGGGGGDGIIRHNRRCRDLAFLVLFAAFWVAMIVNSSFGFNQGNPLRLTYELDYKGNICGSRHGDPDLHELDVRYWMNPNQVYQSGVKDNKINLADAKAICLMECPMPAADGLNFVCDYPEGDIRLSVDDWIDRDYDYFEFLTPDMRNSSLQLQGPCYPVIFPSVNVYWSCQFIARASNVSLKHWQQMGGINIDENILIDKTIHKAINSKSSVLKRYVADIGKSWPVLIVCGGLLPLFLSVIWLLLIRYFVVATPWITVVVFNALVISVTMFFYIKAGWLGNDPLTVVIGESDPYVHITGREISHLHAATVVMTVVMIIAFLTSIAIIRRILIATPVLKVAAKVIGEVQALIIFPVVPYFILAIFYMFWFSATLHLFSSGQVLRNDCNTDCCSYDLKLGKVNCDNCCGYSIHYTPHIGIAILFHLFGCYWATQFFIACSSTVIAGSVASYYWARGEISHDIPFVTVVSSMKRLLRYSLGSVAIGSLVVSAVEWVRFILECLRRKLKLVDSARESCFGKMTSSSSQCCLGCIDWTLKSVNRNAYIMIAITGKGFFKASVLATGLIMNNILRIGKVNVIGDVILFLGKLCVSLFCALFAFLMLDTHKYKSAHNKISSPLVPVVVSWALGFIVAKLFFQVVEMSIDTIILSFCQDAEEHQGNAQYAPPLLMETLDEQSELQRLTQGP

SEQ ID NO: 4253 - protein, 711 aa, Oryza sativa
MGGPLGAIIGRHPAAAGGGGEDELGGGGGGGDGGGIIRHNRRCRDLAFLVLFAAFWVAMIVNSSFGFNQGNPLRLTYELDYKGNICGSRHGDPDLHELDVRYWMNPNQVYQSGVKDNKINLADAKAICLMECPIPAADGLNFVCDYPEGDIRLSIDDWINRDYDYFEFLAPDMRNSSLQLQGPCYPVIFPSVNVYWSCQFIARASNVSLKHWQQMGGINIDENILIDKTIHKAINSKSSVLKRYVADIGKSWPVLIVCGGLLPLFLSVIWLLLIRYFVAAMPWITVVLFNALVISVTMFFYIKAGWLGNDPLTVVIGESDPYVHITGREISHLHAATVVMTVVMIIAFLSSIAIIRRILIATPVLKVAAKVIGEVQALIIFPVVPYFIFAIFYMFWFSATLHLFSSGQVLRNDCNTDCCSYDLKLGKVNCDNCCGYSIHYTPHIGIAILFHLFGCYWATQFFIACSSTVIAGSVASYYWARGEISHDIPFVTVVSSLKRLLRYSLGSVAIGSLVVSAVEWVRFILECLRRKLKLFDSARESCFGKMTSSSSQCCLGCIDWTLKSVNRNAYIMIAITGKGFFKASVLATGLIMNNILRIGKVNVIGDVILFLGKLCVSLFCALFAFLMLDTHKYKSAHNKISSPLVPVVVSWALGFIVAKLFFQVVEMSIDTIILSFCQDSEEHQGNAQYAPPLLVETLDEQSELHRLTQGP

SEQ ID NO: 4254 - protein, 712 aa, Brachypodium distachyon
MGGPLGAIIGRYPSAATGGGGEDELGSGGGGGGGEGIIRHDRRCRDLAFLVLFAAFWVAMIVNSSFGFNQGNPLRLTYELDYKGNVCGDRHGDPDVHELDVRYWMDPNQVYQSGLKSSKVNLADAKAICLMECPTPAPDRLNFVCDYPEGDIKLSVDDWINRDYDYFDFLTPDMRNSSLQLQGPCYPVIFPSVNVYWSCQYIARASNVSLKHWLQMGGVNIEENLLIDKTSHKAVDSRSAVLKRYVADIGKSWPVLIVCGGLLPLFLSVIWLLMIRYFVAAMTWITVVLFNALVISVTMFCYIKAGWIGNDPLTVVIGESDPYVHITGREISHLHAATVLMTIIMIIAFLSSIAIIRRILIATPVLKVAAKVIGEVQALIFFPVVPYFILAIFYMFWFSATLHLFSSGQVIRNDCNTDCCSYDLKLGKVNCDNCCGYSIHYTPHIGIAILFHLFGCYWATQFFVACSSTVIAGSVASYYWARGEISHEIPFFTVVSSLKRLLRYSLGSAAIGSLVVSPVEWVRFILECFRRKLKLVGSARESCFGKMTSSSSQCCLGCIDWTLMSVNRNAYIMIAITGKGFFKASVLATGLIMNNILRIGKVNVIGDVILFLGKLCVSLFCALFAFLMLDTHKYKSAHNKISSPLVPVLVTWALGYTVAKLFFAVVEMSIETIILSFCQDAEEHQGNAQYAPPLLMETLDEQSELQRLTQGP

SEQ ID NO: 4255 - protein, 705 aa, Panicum virgatum
MGGPLGAIIGRYPSAAAGGDDELGGGGAGIIHHNRRCRDIAFLVIFAAFWVAMIVNSSFGFNQGNPLRLTYELDYKGNICGDKHGDPNLHELDVRYWMNPNQVYQSGLKNSKVNLADAKAICLMECPNPAVDGLNFICDYPEGDIRLSVDDWINRDYDYFEFLTPDMRNSSLQLQGPCYPVIFPTVNVYWSCQFIARASNVSLKHWQQMGGVSIDENILIDKTVHKAIDSRSAVLKRYIADIGKSWPVFIVCGGILPVFLSVIWLLMIRYFVAAMTWITVVLFNVLVISVTMFCYIKAGWIGSDPLTVVIGESDPYVHISGREISHLHTVTIFMTAVMIIAFLSSIAIVRRILIATPVLKVAAKVIGEVQALIVFPLVPFFILAIFYMFWFAATLHLFSSGQVVRNDCNIDCCSYDLKLGKVNCDNCCGYSIHYTPHISIAILFHLFGCYWATQFFLACSSTVIAGSVASYYWARGEISHDIPFLTVVSSLKRLMRYSLGSVALGSLVVSIVEWVRFILECLRRKLKFVGSARESCFGKAASSSSECCLGCIDWTLKSVNRNAYIMIAITGKGFHKASVLATGLIMKNILRIGKVNVIGDVILFLGKLCVSLFCALFAFLMLDTHKYKSAHNKISSPLIPVLVTWALGYIVAKLFFAVVEMSIDTIILSFCQDAEEHQGNAHYAPPLLMETLDEQSDLQRLTQGP

SEQ ID NO: 4256 - protein, 709 aa, Brachypodium distachyon
MRWPLGAIIGRHASAAAAGAGGEKDAGAGAGVIRHDRKCRDLPFLALFAAFWVAMIVNSSFGFNQGNPLRLTFGLDYKGNICGSKHGDPNLHELDVRYWMNPNQVYQSGLKSNQINLPDAKAICLMECPYPAEDGLNFVCDYPDGDIRLSVDDWIDRDYDYFEYLTPDMRNSSLQLQGPCYPIIFPSINVYWSCQFIARPSNVSLKHWQQMGGVSIDANMLIDKTIHNAVNSKSSVLKRYVADIGKSWPVLIVCGGLLPLLLSLIWLAMIRYFVSGMPWVTVVIFNVLVISVTMFFYIKAGWIGNDPLTVVIGASDPYVSISGREINHLHVAAVLMTVVMIIAFLTSIAIVRRILIATSVLKVAAKVIGEVHALIIFPIVPYFVLAIFYMLWFSATLHLFSAGQVLRNDCNSNCCSFDLKLGKVNCDNCCGYSIHYTPHIGLAILFHLFGCYWATQFFIACSSTVIAGSVASYYWARDEISHDIPFHTVVSSLKRLLRYSLGSVALGSLMVSVVEWVQFVLKSIRRRLKVVDSARESCFGKTVSSSSHCCLGCIDWTIKSVNRNAYIMIAITGKGFCKASELATGLIMNNILRIGKVNVIGDVILFLGKLCVSLSSVLFAFLMLDNHKYRSSHSKISSPLFPVLLCWALGYAVAQLFFGVVETSVETVVLSFCQDAEEHQGDAQYAPPVLMETLLGGDPTQLQRLTAQP

SEQ ID NO: 4257 - protein, 710 aa, Setaria italica
MGGPLGAIIGRYPSAAAGGGGEDELGGGGASGAGIIRHNRRCRDIAFLVLFAAFWVAMIVNSSFGFNQGNPLRLTYELDYKGNICGDKHGDPNLHELDVRYWMNPNQVYQSGLKNSKVNLADAKAVCLMECPNPAVDGLNFICDYPEGDIHLSVDDWINRDYDYFEFLTPDMRNSSLQLQGPCYPVIFPTVNVYWSCQFIARASNVSLKHWQQMGGVSIDENILIDKTVHKAIDSRSAVLKRYIADIGKSWPVFIVCGGILPVFLSVIWLLMIRYFVAAMTWITVVLFNALVISVTMFCYIKAGWIGNDPLTVVIGESDPYVHISGREISHLHTVTIFMTAVMIIAFLSSIAIVRRILIATPVLKVAAKVIGEVQALMFFPLVPFFTLAIFYMFWFSATLHLFSSGQVVRNDCNTDCCSYDLKLGKVNCDNCCGYSIHYTPHISIAILFHLFGCYWATQFFLACSSTVIAGSVASYYWARGEISHDIPFLTVVSSLKRLMRYSLGSVALGSLVVSVVEWVRFILECLRRKLKFVGSTRESCFGKATSSSSECCLGCIDWTLKSVNRNAYIMIAITGKGFHKASVLATGLIMKNILRIGKVNVIGDVILFLGKLCVSLFCALFAFLMLDTHKYKSAHNKISSPLIPVLVTWALGYIVAKLFFAVVEMSIDTIILSFCQDAEEHQGNAQYAPPLLMETLDEQSDLQRLTQGP

SEQ ID NO: 4258 - protein, 705 aa, Sorghum bicolor
MGGPLGAIIGRYPSAAGGDEQLGGGASGGIIRHDRRCRDIAFLVLFAAFWVAMIVNSSFGFNQGNPLRLTYELDYKGNICGDKHGSPNLQELDVRYWMNPNQVYQSGLKDSKVNLADAKAICLMECPNPAVDGLNFICDYPEGDIHLSVDDWINRDYDYFEFLTPDMRNSSLQLQGPCYPIIFPTVNVYWSCQFIARASNVSLKHWHEMGGVSIDENILIDKTVHKAIDSRSAVLKRYIADIGKSWPVFIVCGGILPVFLSVIWLLMIRYFVAAMTWITVVLFNALVISVTMFFYIKAGWIGNDPLTVVIGESDPYVHISGREISHLHTVTILMTAVMIIAFLSSIAIVRRILIATPVLKVAAKVIGEVQALIAFPLLPWLILSIFYMFWFSATLHLFSSGQVVRNDCNTDCCSYDLKLGKVNCDNCCGYNIHYTPHISIAILFHLFGCYWATQFILACSSTVVAGSVASYYWARGEISHDIPFLTVVSSLKRLMRYSLGSVALGSLLVSVVEWVRFILECLRRKLKLVDSARESCFGKATSSSSECCLGCIDWTLKSVNRNAYIMIAITGKGFFKASVLATGLIMKNILRIGKVNVIGDVILFLGKLCVSLFCALFAFLMLDTHKYKSAHNKISSPVIPVLVTWALGYIVAKLFFAVVEMSIDTIILSFCQDAEEHQGNAQYAPPALMETLDEQGELQRLTQGP

SEQ ID NO: 4259 - protein, 700 aa, Secale cereale
GRDASAAGAGGGKGGDDDAAAGIIRHDRKCRDLPFLALFAAFWVAMIVNSSFGFNQGSPLRLTYGLDYKGNICGSKHGDPDLSELDVRYWVNPNQVYQSGLKNSTSDLADAKSICLMECPYPAEDGLNFVCDYPEGDIRLSVDDWIDRDYDYFEYLTPDMRNSSLQLQGPCYPIIFPSINVYWSCQFIARPSNVSLKHWQQMGGVSIDENMLIDKTIHNTINYKSSVLKRYVADIGKSWPVLIVCGGLLPLFLSLIWLAMIRYFVAVMPWITVILFNALVVSVTMFFYIKAGWIGNDPLTVVIGPSDPYVSIGGREINHLHAAAVLMTVVMIIAFLTSIAIVRRILIATSTTVLKVAAKVIGEVHALIIFPVVPYFALAIIYMFWFAATLYLFSSGQVLQNDCNAECCSFDLKLGKVNCDSCCGYSVHYTPHIGIAILFHLFGCYWATQFFIACSSTVIAGSVASYYWARGEISHDIPFHTVVSSLKRLLRYSLGSVALGSLVVSSVEWVRCILKSLRRRLKGVDSTGESRLGKTVSSSSHCCLGCIDWTIKSVNRNAYIVIAVTGKGFCKASELATGLIMNNILRIGKVNVIGDVILYLGKLCVSLSSALFAFLMLDTHKYRSAHNKISSPLFPVLLCWALGYVVAQLFFGVVEASVETIILSFCQDAEEHDGEAQYAPPLLMETLGDTSQLQRLTQGP

SEQ ID NO: 4260 - protein, 706 aa, Hordeum vulgare
MRGPLGRDASAGGAGGGKGGDDDDAAADIIRHDRKCRDLPFLALFAAFWVAMIVNSSFGFNQGSPLRLTYGLDYKGNICGSKRGDPDLSELDVRYWLNPNQVYQSGLKNSTSDLADAKSICLMECPYPAEDGLNFVCDYPEGDIRLSVDDWIDRDYDYFEYLTPDMRNSSLQLQGPCYPIIFPSINVYWSCQFIARPSNVSLKHWQQMGGVSIDENMLIDNTIHNTINYKSSVLKRYVADIGKSWPVLIVCGGLLPLFLSLIWLAMIRYFVAGMPWITVILFNALVISVTMFFYIKAGWIGNDPLTVVIGPSDPYVSIGGREINHLQAAAVLMTVVMIIAFLTSIAIVRRILIATSTTVLKVAAKVIGEVHALIIFPVVPYFALAIIYMFWFAATLYLFSSGQVVQNDCNAECCSFDLKLGKVNCDSCCGYSVHYTPHIGIAILFHLFGCYWATQFFIACSSTVIAGSVASYYWARGEISHDIPFHTVVSSLKRLLRYSLGSVALGSLVVSSVEWVRFILKWLRRRLKGVDSTGESRLGKTVSSSSHCCLGCIDWTIKSVNRNAYIVIAVTGKGFCKASELAMGLIMNNILRIGKVNVIGDVILYLGKLCVSLSSALFAFLMLDTHKYRSAHNKISSPLFPVLLCWALGYVVAQLFFGVVETSVETIILSFCQDAEEHDGEAQYAPPLLMETLGDTSQLQRLTQGP

SEQ ID NO: 4261 - protein, 713 aa, Triticum aestivum
MGGPLGAIIGRYPSAAAGTGGDDADHPGGGGGTVSLGIIRHDRRCRDLAFLVLFAGFWVAMIVNSSFAFNQGNPLRLTYELDYKGNVCGDRHGDPDVHELEVRYWLDPNQVYQSGVKGSKANLADAKAICLMECPTPAPDGLNFVCDYPEGDVRLSVDDWINRDYNYFDVLTPDMRNSSLQLQGPCYPVIFPSVNVYWSCQYIARASNVSLTHWQQMGGVNIEQNMLIDKTIHKAIDSRSAVLKRYVADIGKSWPVLIVCGALLPLFLSVIWLLMIRYFVAAMTWITVVLFNALIVSVTMFCYIKAGWLGNDPLTVVIGESDPYVHISGREISHLHVATVLMTVIMIIAFLSSIAIVRRILIATPVLKVAAKVIGEVQALIVFPVVPYFILAIFYMFWFSATLHLFSSGQVVRNDCSTDCCSYDLKLGKVNCDNCCGYSIHYTPHIGIAILFHLFGCYWATQFFMACSATVVAGSVASYYWARGEISHDIPFVSVVSSLKRLMRYNLGSAAIGSLVVSAVEWVRFILECLRRKLKLVGSAGESCFGKVSSSSSQCCRGCIDWTLMSVNRNAYIMIAITGKGFFKASVLATGLIMNNILRIGKVNVIGDVILFLGKLCVSLFCALFAFLMLDTHKYKSAHNKISSPLVPVLVTWGLGYTVAKLFFAVVEMSIDTIILSFCQDAEEHQGTAQYAPPLLMETLDEQGELQRLTQGP

SEQ ID NO: 4262 - protein, 705 aa, Zea mays
MGGPLGAIIGRYPSAAGGDEQLGGGAGGGIIRHDRRCRDIAVLVLFAAFWVAMIVNSSFGFNQGNPLRLTYELDYKGNVCGDKHGNPNLQELDVRYWMNPNQVYQSGLKNSKVNLADAKAICLMECPNPAVDGLNYICDYPEGNIDLSVDDWINRDYDYYEFLTPDMKNSSLQLQGPCYPIIFPTVNVYWSCQFIARASNVSLKHWHETGGVSIDENILIDKTVHKAIDSRSAVLKRYIADIGKSWPVFIVCGGILPVFLSVIWLLMIRYFVAAMTWITVVLFNALVISVTMFFYIKAGWIGNDPLTVVIGESDPYVHISGREISHLHTITILMTAVMIIAFLSSIAIVRRILIATPVLKVAAKVIGEVQALIAFPLLPCLILSILYMFWFSATLHLFSSGQVVRNDCNTDCCSYDLKLGKVNCDNCCGYSIHYTPHISIAILFHLFGCYWATQFILACSSTVVAGSVASYYWARGEISHDIPFLTVVSSLKRLMRYSLGSVALGSLVVSVVEWVRFILECLRRKLKLVDSARESCFGKATSSSSECCLGCIDWTLKSVNRNAYIMIAITGKGFFKASVLATGLIMKNILRIGKVNVIGDVILFLGKLCVSLFCALFAFLMLDTHKYKSAHNKISSPVIPVLVTWALGYVVAKLFFAVVEMSIDTIILSFCQDAEEHQGNAQYAPPALMETLDEQGELQRLTQGP

SEQ ID NO: 4263 - protein, 279 aa, Saccharum officinarum
MACRGFFECVLKLLNLVVMAVGLAMVGYGAYLLVMWLQVAPLPPPAPPSPSPAAVPPGGDLVRLGRPLLLLVDACLSDADGTVERLSSAWFIFAFIGVGAILFITSIFGCAGARNGCCLSIYSFLIILFILVELGAGGFIFFNHSWKEVIPVDKTGNFDMMYSFLKENWRIAKWVALGAVVFEALLFTVAIIVQSGNQADYDSDDEYIGARSGIRQPLVNQQAAAAADPRVPNLDYRPIRNDAWSQRMREKYGVDSFDPNRFQQATISPGEQRNRCTIL

SEQ ID NO: 4264 - protein, 275 aa, Zea mays
MACRGFFECVLKLLNLVVMAVGLAMVGYGAFLLVTWLQVAPLPPPSSSPDAVPPSGELVRLGRPLLLFVDASLSDGTAERLSSAWFIFAFIGVGAILFVTSIFGCAGARNGCCLSIYSFLIILFILVELAAGGFIFFNHSWKEVIPVDKTGNFDMMYSFLKENWRIAKWVALGAVVFEALLFTVAIIVQSGNQTDYDSDDEYIGARSGIRQPLVNQQAAAAAADPRVPNLDYRPIRNDAWSQRMREKYGVDSFDPNRFQPATISPGEQRNRCTIL

SEQ ID NO: 4265 - protein, 274 aa, Panicum virgatum
MACRGFFECVLKLLNLVVMAVGLAMVGYGAYLLVMWLQVVPPAPAPAPVAVAASGELVRLGRPLLLLVDASALSDGTAKKLSSAWFIFVFIGVGVVLFITSIFGCAGARNGCCLSIYSFLIILFILVELAAGGFIFFNHNWKEVVPVDKTGNFNMMYSFLKENWRIAKWVALGAVIFEALLFTVAIIVQSGNQADYDSDDEYIGPRSGIRQPLVNQHQQAATDPRVPNLDYRPIRNDAWSQRMREKYGVDSFDPNRFQQATISPAEQRNRCTIL

SEQ ID NO: 4266 - protein, 274 aa, Panicum virgatum
MACRGFFECVLKLLNLVVMAVGLAMVGYGAYLLVMWLQVVPPAPAPAPAAVAASGELVRLGRPLLLLVDASALSDGTAKKLSSAWFIFAFIGVGVVLFITSIFGCAGARNGCCLSIYSFLIILFILVELAAGGFIFFNHNWKEVVPVDKTGNFDMMYSFLKENWRIAKWVALGAVIFEALLFTVAIIVQSGNQADYDSDDEYIGPRSGIRQPLVNQHQQAAADPRVPNLDYRPIRNDAWSQRMREKYGADSFDPNRFQQATISPAEQRNRCTIL

SEQ ID NO: 4267 - protein, 278 aa, Setaria italica
MACRGFFECLLKLLNLIVMAVGLAMVGYGAYLLVMWLQVVPPPAPPLPPSPAPVVVAAGGELVRLGRPLMLLVDASSLSDGTAERFSSAWFIFTFIGVGVVLFITSIFGCAGARNGCCLSIYSFLIILFILVELATGGFIFFNHSWKEVIPVDKTGNFDMMYSFLKENWRIAKWVALGAVIFEALLFTVAIIVQSGNQADYDSDDEYIVPRSGIRQPLVNQQQGAADPRVPNLDYRPIRNDAWSQRMREKYGVDSFDPNRFQQATISPAEQRNRCTIL

SEQ ID NO: 4268 - protein, 113 aa, Panicum virgatum
MACRGFFECVLKLLNLVVMAVGLAMVGYGAYLLVMWLQVVPPPAPPLPPSPSPVAVAASGELVRLGRPLLLLVDASALSDGTAKKLSSAWFIFVFIGVGCCTFHHIDLWLCWS

SEQ ID NO: 4269 - protein, 278 aa, Brachypodium distachyon
MACRGFFECVLKLLNFVVMVVGLAMAGYGAYLLVLWLQVLSPPLPPSPAPPAAVAPSGGDLVRLGRPMLLLLDASLSDNGTVERLSSAWFIFAFIGIGVILFITSIFGCAGASTRSGCCLSTYSFLIILFILVELAAGCFIFFDHDWKNVIPVDKTGNFDMIYSFLKENWRIAKWVALGSVVFEALLFTVALIVQSGIQDDYDSDDEYIGARSGVRQPLVNKQAAADPRVPNLDYRPIRNDAWSQRMRDKYGVDTFDPNRFQQATISPAEQRSRCTIL

SEQ ID NO: 4270 - protein, 269 aa, Triticum aestivum
MACRGFFECVLKLFNLVLMAVGLAMAGYGAYLLVLWLQLLPPSPPAPPPSGDLVRLGRPMLLLIDVSISDGTSEKLISAWFIFAFIGVGVILFITSIFGCAGASTRSGCCLSTYSFLIILFILVELAAGCFIFFDHSWKDVIPVDKTGNFDMIYSFLKENWRTAKWVALGAVVFEALLFTVALIVQSGNQDDYDSDDEYIGPRSGVRQPLVNKQTATDPRVPNLDYRPIRNDAWSQRMRDKYGVDSFDPNRFQQATISPAEQRNRCTIL

SEQ ID NO: 4271 - protein, 269 aa, Triticum aestivum
MACRGFFECVLKLLNLVLMAVGLAMAGYGAYLLVLWLQLLPPSPPAPPPSGDLVHLGRPMLLLIDVSISDGTSEKLISAWFIFAFIGVGVILFITSIFGCAGASARSGCCLSTYSFLIILFILVELAAGCFIFFDHSWKDVIPVDKTGNFDMIYSFLKENWRTAKWVALGAVVFEALLFTVALIVQSGNQDDYDSDDEYIGLRSGVRQPLVNKQTATDPRVPNLDYRPIRNDAWSQRMRDKYGVDSFDPNRFQQATISPAEQRNRCTIL

SEQ ID NO: 4272 - protein, 278 aa, Oryza sativa
MACRGFFEWVLKLLNLVVMVVGLAMMGYGAYLLVAWLQLLPSPPPLPPAPAVAPGGGGGGEMVRLGRPLLLLLDVSSLPDGTAERLSAAWFIYAFIGVGVILFITSIFGCAGASRGGCCLSFYSFLIILFILVELAAGGFIFFNHSWKDVIPVDKTGNFDMMYSFLKENWRIAKWVALGAVLFEAVLFTVALIVQSGNQADYDSDDEYIAPRSSTRQPLVNKQPVADPRVPNLDYRPIRNDAWSQRMREKYGVDTFDPNRFQQATISPAEQRNRCAIL

SEQ ID NO: 4273 - protein, 273 aa, Avena sativa
MACRGFFECILKLLNLVVMVVGLAMTGYGGYLLVMWLQVLTPSPAPPPSVAPSGDLVRLGRPMLLLLDASLSDGTVERLSSAWFIFAFIGIGVILFITSIFGCAGASTRSGCCLSTYSFLIILFIIVELAAGCFIFFDHSWKDVIPVDKTGNFDMIYSFLKENWKNAKWVALGAVVFEALLFTVTLIVQSGNQDDYDSDDEYIGPRSGVRQPLVNNKQTVTDPRVPNLDYRPIRNDAWSQRMRDKYGVDTFDASRFQQATISPAEQRSRCTIL

SEQ ID NO: 4274 - protein, 269 aa, Hordeum vulgare
MACRGFFECVLKLLNLVLMAVGLAMAGYGAYLLVFWLQLLPPSPPAPPPSGDLVRLGRPMLLLIDVSISVGTSQKLISAWFIFAFIGVGVILFITSIFGCAGASTGSGCCLSTYSFLIILFILVELAAGCFIFFDHGWKDVIPVDKTGNFDTIYSFLKENWRTAKWVALGAVVFEALLFTVALIVQSGNQDDYDSDDEYIGPRSGVRQPLVNKQTVTDPRVPNLDYRPIRNDAWSQRMRDKYGVDSFDPNRFQQATISPAEQRNRCTIL

SEQ ID NO: 4275 - protein, 269 aa, Secale cereale
MACRGFFECVLKLLNLVLMAVGLAMAGYGAYLLVLWLQLLPSSPPAPPPSGNLVHLGRPMLLLIDVSISDGTSEKLISAWFIFAFIGVGVILFITSIFGCTGASTRSGCCLSTYSFLVILFVLVELAAGCFIFFDHGWKDVIPVDKTGNFDMIYGFLNENWRTAKWVALGAVVFEALLFTVALIVQSGNQDDYGSDDEYIGPRSGVRQPLVNKQTATDPRVPNLDYRPIRNDAWSQRMRDKYGVDSFDPNRFQQATISPAEQRNRCTIL

SEQ ID NO: 4276 - protein, 732 aa, Panicum virgatum
MPPQLEHDEQQTAGSGGHRAAPPPPPPPNMLLTFSSSSSSSGAPSSTCVATTTTTTATTNSSGAVVHPTTSSPPSSAAASLRPAANSFPLVLKFEEVVYKVKLGQPTAGWCDKLSAAASMAVGGSGDAGRQKKAVSAAGSSPAREKTIISGMSGVVRPGEMLAMLGPSGSGKTTLLTALGERHGHGGRALLSGKITYNGQPFSGAVKRRTGFVTQHDVLYPHLTVAETLWYTALLRLPRALGAGEKRAQAEAVARELGLAKVAHSMVGGVRGVRGLSGGERKRVSIGLEMLVDPSLLLLDEPTSGLDSTTAARIVGTLRRMAADGGRTVVVTIHQPSSRLYHMFDKVLLLSADGCPIYYGRAADALSYFASVGFASPLSLNPADLMLDLANGIAPQTASGDGDGVAAVTGGSESEHKEVRAKLAAAYERHIAPAVKLDICARETAAPQASAARRGPAPSEWTTGWWTQFVVLLQRGLKERRHESFNKLRVLQVLSVASLAGLLWWRTPAAHLQDRTALVFFFSVFWGFFPLYNAVFTFPLERPMLLKERSSGMYRLSSYLASRAAADLPMELGLPTAFVVILYWMSGLDPRPGPFLLSLAVVLYSVLVAQSLGLAIGAVLMDVKQGTTLASVITMVFLIAGGYYVQHIPPFVAWLRWLNYSFYCYRLLLGIQFPNGGGYYDCGHGALCPVAEFPAIKAVGLNNHWVDVCVMALLLVGYRVVAYVALDRLKPR

SEQ ID NO: 4277 - protein, 747 aa, Setaria italica
MPPPLEQDEQQTAGGGSHRAAPPPPPPPNMIAFSSCSSSSSSSSGTPSCTSVATTTTTTATTNSSSGAVVHPTTSSPPSPADARLRPAANSFPLVLKFEEVVYKVKLGQPTAGWCDKLSAAASMAVGGGDGRKKKAAAPGSSAREKTIISGMSGVVRPGEMLAMLGPSGSGKTTLLTALGGRHGGRALLSGKITYNGLPFSGAVKRRTGFVTQHDVLYPHLTVAETLWYTALLRLPRALSAGEKRSQAEAVARELGLAKVAHSMVGGVRGVRGLSGGERKRVSIGLEMLIDPSLLLLDEPTSGLDSTTAARIVGTLRRMAAGGGRTVVVTIHQPSSRLYHMFDKVLLLSADGCPIYYGRAADALSYFASVGFASPLSLNPADLMLDLANGIAPQTASGDGDVGEARPAAVTGGSESEHKEVRAKLAAAYERHIAPAVKLDICARETSAAASPGGGQAPSSRRRGSASSEWTTGWCTQFLVLLQRGLKERRHESFNKLRIFQVLSVASLAGLLWWRTPASHLQDRTALVFFFSVFWGFFPLYNAVFTFPLERPMLLKERSSGMYRLSSYFASRAAADLPMELGLPTAFVLILYWMGGLDPHPGPFLLSLAVVLYSVLVAQSLGLAIGAVLMDVKQGTTLASVITMVFLIAGGYYVQHIPPFVAWLRWLNYSFYCYRLLLGIQFPNGGGYYDCGGGAMCPVAEFPAIKAVGLNNHWVDVCVMALLLVGYRVVAYIALDRLKPEVNESHG

SEQ ID NO: 4278 - protein, 741 aa, Panicum virgatum
MPPQLEHDEQQTAASGGHRAAAPPPPPPPHMLLTFSSSGGGGGGGGAPSSTSVATTNSSGAVVHPTTSSPPSSAAAARLRPAANSFPLVLKFEEVVYKVKLGQPTAGWCDKLCAAARSMAVGGGGGGDGRRKKNAAAGSSSSLAREKTIISGMSGVVRPGEMLAMLGPSGSGKTTLLTALGGRHGGGAALSGKITYSGQPFSGAVKRRTGFVTQHDVLYPHLTVAETLWYTALLRLPRALGAAEKRAQAEAVARELGLAKVAHSMVGGVRGVRGLSGGERKRVSIGLEMLVDPSLLLLDEPTSGLDSTTAARIVGTLRRMAADGGPTVVVTIHQPSSRLYHMFDKVLLLSADGRPIYYGRAADALSYFAAVGFASPLSLNPADLMLDLANGIAPQTTSGDADGGGEARMAAAVAGGSESEHKEVRAKLAAAYERHIAPAVKLDICAREPAAAASPPQAPSSARRRGPSEWTTGWWTQFLVLLQRGLKERRHESFNKLRVFQVVSVASLAGLLWWRTPASHLQDRTALIFFFSVFWGFFPLYNAVFTFPLERPMLLKERSSGMYRLSSYLAARAAADLPMELGLPTAFVVILYWMGGLAPRPGAFLLSLAVVLYSVLVAQSLGLAIGAVLMDVKQGTTLASVITMVFLIAGGYYVQHIPPFVAWLRWLNYSFYCYRLLLGIQFPNGGGYYDCGGGAMCPVAEFPAIKAVGLNNHWVDVCVMALLLVGYRVVAYVALDRLKPR

SEQ ID NO: 4279 - protein, 727 aa, Zea mays
MPPELEHHEQQTAGGGGHRAPPPPPNSMPTFSSSTPSSTCVSATTNPSGGAGAVHPTTSSPASSASARPAVNSFPLVLKFEEVAYKVKLGKPTTTTAGWCDKLSAAAASMAVGGGRKKKATAAAAGSSPSSPAALREKTRTIISGMSGVVRPGEMLAMLGPSGSGKTTLLTALGGRHGGGGRALLSGKITYNGQPFSGGVRRRTGFVTQHDVLYPHLTVAETLWYAAALRLPRALGAGEKRARAEAVARDLGLGKVAGSMVGGVRGVRGLSGGERKRVSIGLEVLVDPSLLLLDEPTSGLDSTTAARIVATLRRMAAEGGRTVVVTIHQPSSRLYHMFDKVLLLSADGRPIYYGRAADALSYFASVGFASPLSLNPADLMLDLANGIAPQTTSGDGMAALLAGGGEGEHKEVRGRLSAAYERHIAPAVKLDVCAREATPGGQQAASRRASKAASEWTTGWWTQFAVLVQRGLKERRHESFNKLRVFQVLSVAALAGLLWWRTPASHLQDRTALVFFFSVFWGFFPLYNAVFTFPLERPMLLKERASGMYRLSSYVASRAATDLPMELGLPTAFVLILYWMGGLDPRPGPFLLSLAVVLYSVLVAQSLGLAIGAVLMDVKQGTTLASVITMVFLIAGGYYVQHIPPFVAWLRWLNYSFYCYRLLLGIQFPDGGGYYDCGHGALCPVAEFPAIKAVGLNNHWVDACVMALMLVGYRVVAYIALDRLKPR

SEQ ID NO: 4280 - protein, 280 aa, Zea mays
MAIRMSNNVIGALNLVTLLLSVPILVSGIWLRSRADGTECDHLLSTPAIALGAVLMAVAVAGLAGACFRATWLLWLYLLAMLVFIVALLCFTVFAFAVTNRGAGEAVSGVGYREYRLGDYSTWLRRHVESRKDWARIRSCLADAHVCRRLEERERESKDAAGSGSARPVPGRVRVLQAAHELQLHVHRRHGVDQDSGGLRARRPGLQRVGQRRGRPLLRVPVVQGRRGGRAQAGLEAGRHRQRRHPLLHRRRLLRRLLRLQEQPPGQLRLPQRPRMETRR

SEQ ID NO: 4281 - protein, 587 aa, Zea mays
MWKDKVKLKRIRERQQKLALQRLELEKTKTKKISDQALRKKMTRAQDGILKYMLKLMEVCNARGFVYGIIPEKGKPVSGASDNIRAWWKDKVKFDKNGPAAIVKYELENSMLSNPKGGGAMDQHSLMDLQDGTLGSLLSALMQHCSPQQRSYPLDKGVPPPWWPTGNESWWPALGLPKGEAPPYRKPHDLKKVWKVGVLTGVIKHMAPNFDKIRNRVRKSKCLQDKMTAKESLIWLGVLQREEKSVHGFGSALLQNARHSSTSEDRNEGIYSSSDEYDVDRLEQPPRSTSSKEDEGDAQPVLQIRGEQTSTRGTNKRRRHDTSSNQLAISKEEMSKSKSQQRKGPSTRPPVAEVEVEVTQRNDKTPEVVCSAAGGDMNFIDPIDAVGITNLPMSPKHVPPTIGALQQHGDCRGNFLSPAAAINYNSSNSNQAASAAQSNTYLGGHPLACEGSDIANSWSGHSFQQDVGLGPPIGFDPSPVAHQGSAVQQPLPLPLPLPMDHQAPITGSGALATNGSYSLPTAGGVSSGTIVSETHQQLMDNPFFGDAGDSSFGGLPFSLLPFSSPMLNFDELDELVDDDDLMQYLGT

SEQ ID NO: 4282 - protein, 231 aa, Saccharum officinarum
MASAPSAPASAAVKAAVLPIPPVQPPPAVAVVARRAPVPAALRALGGRGAALVASAALDDLRPAIDEYPEGILSGEWPGNFSLLSYADLRAYLESQIVTSDQMSPAAKLGDVMSRPVQVATPGQRLAEVDAIFAAQQYSGLPVVDEDGRCVGVISKKDKAKAPNGMESTVGEVMSSPAITLTPQETVLEDAALMLKEKVHRIPVVNEQQQVIGIVTRSDVFQALEANNNKA

SEQ ID NO: 4283 - protein, 233 aa, Pennisetum glaucum
MASAASAPASTVKAAAVLPVPPPTPPSAATVAVARRARPVPTVLRAADGHARRGAAVVAAAALDDLRPAIDEYPEGVLSGEWPENFSLLSYADLRAYLESQITTTGEMSPAAKLGDVMSHPVQVATPGQRLAEIDAFFATQQFSGLPVVDKGGVCVGVVSKKDKAKAPNGMESTVGEVMSSPAITLTPEKTVLEAAALMLKEKVHRIPVVNEQQQVIGIVTRTDVFQALEANN

SEQ ID NO: 4284 - protein, 439 aa, Saccharum officinarum
SRGKTLVERYEMGRLLGKGTWGKVHYGRNLESNQSVAIKMMDKDKVLKVGLSEQIKREITTMRLVAHKNIVHLHEVMATRNKIYIVMEYVKGGELFDKIDKSGKLTEAAAHKYFQQLISAVDHCHSRGVYHRDLKPENLLLDENENLKVSDFGLSALSESKRQDGLLHTTCGTPAYVAPEVISKIGYDGAKSDIWSCGVALFVLAAGYLPFQGPNLMEIYRKIQHGEFRCPSWFSHKLKKLLYKILDPNPSTRISIQKIKESTWFRKSPGEIRAVKEKILSENATTNAAPVLATRHKKIAHEDMKAATNLNAFEIISFSTGLDLSGLFIKKECRKETRFTSDKPALTIISKLEEVAKALNLRIRKKDNGIVKIQGRKEGRNGILQFDTEIFEITPSYHLIEMKQTSGDSVEYQKLLEEDIRPGLKDIVWAWHGNDLQQK

SEQ ID NO: 4285 - protein, 443 aa, Sorghum bicolor
MESRGKILMKRYELGRLLGKGTFGKVHYARNLESNQSVAIKMMDKDKVLNVGLSEQIRREITTMRLVAHKNIVELHEVMATRNKIYFVMEYVKGGELFDKIEKSGKLTEAVAHKYFQQLISAVDYCHSQGVYHRDLKPENLLLDENENLKVSDFGLSALSESKRQDGLLHTTCGTPAYVAPEVISKTGYDGAKSDIWSCGVVLFVLVAGYLPFQGPNLMEMYRKIQNGNFRCPSWFSHKLKKLLYKILDPNPNTRISVQKIKESTWFRKGPGETRTVKEKIPSENATTNAAPVLAMRRKKNVHEDVKPLAVTNLNAFEIISFSTGFDLSGLFIKKECKKETRFTSDKPAAAIISKLEDVAKILNLRIRKMDNGVVKIQGRKEGRNGVLQFDAEIFEITASYHLIEMKQTGGDSLEYQKLLEENIRPALKDIVWAWHGDDQQQK

SEQ ID NO: 4286 - protein, 445 aa, Setaria italica
METRGKILMERYELGRLLGKGTFGKVHYARNLDSNQSVAIKMMDKDKVLKIGLSEQIRREITTMRLVAHKNIVELHEVMATRNKIYFVMEYVKGGELFDKIEKSGKLTETAAHKYFQQLISAVDYCHSRGVYHRDLKPENLLLDEDENLKVSDFGLSALSESKRQDGLLHTTCGTPAYVAPEVISKIGYDGAKSDIWSCGVVLFVLVAGYLPFQGPNLMEMYRKVQHGDFRCPSWFSHKLKKLLYKILDPNPATRISIQKIKESTWFRKGPEGTRTVKEKIPCENATINAAPTLSVRRKKNPHEDAKPLTVMNLNAFEIISFSLGFDLSGLFIEKECRKEARFTSDKPASAIISKIEDVAKMLNLRVRKKDNGVVKIQGRKEGRNGVLQFDTEIFEITPFHHLVEMKQTSGDSLEYQKLFEEHIRPALKDIVWAWHGDDQQQKQE

SEQ ID NO: 4287 - protein, 444 aa, Setaria italica
MEGRGKILMERYELGRMLGKGTFGKVHYAKNLESNQSVAIKMMDKDKVLKVGLSEQIRREITTMRLVAHKNIVELHEVMATRNKIYFVMEYVKGGELFEKIEKSGKLTEPAAHKYFQQLISAVDYCHSRGVYHRDLKPENLLLDEDENLKVSDFGLSALSESKRQDGLLHTTCGTPAYVAPEVISKIGYDGAKSDIWSCGVVLFVLVAGYLPFQGPNLMEMYRKVQHGDFRCPSWFSHKLKKLLYKILDPNPATRISIQKIKESTWFRKGPEGTRTVKEKIPCENATTNAAPTLSVRRKKNPYEDAKPLPVTNLNAFEIISFSSGFDLSGLFLEKECRKEARFTSDKSASAIILKIEDVAKMLNLRVRKKDNGVVKIQGRKEGRNGVLQFDTEIFEITPFHHLVEMKQTSGDFLEYQKLFEEDIRPALKDIVWAWHGDDQQQKQ

SEQ ID NO: 4288 - protein, 445 aa, Panicum virgatum
MEGRGKILMERYELGRLLGKGTFGRVHYARNLESNRSVAIKMMDKDKVLKVGLSEQIRREITTMRLVAHKNIVELHEVMATRNKIYFVMEYVKGGELFDKIEKSGKLTESAAHKYFKQLISAVDYCHSRGVYHRDLKPENLLLDEDENLKVSDFGLSALSESKRQDGLLHTSCGTPAYVAPEVISKTGYDGAKSDIWSCGVVLFVLVAGYLPFQGPNLMEMYRKIQHGDFRCPSWFSHKLKKLLYKILDPNPNTRISIQKIKESTWFRKGPERTRTVKEKIPCENATTNAAPTLSVRRGKNAYEDVKPLPVTNLNAFEIISFSSGFDLSGLFIEKEHRKDARFTSDKPASAIISKIEDVAKMLNLRVRKKDNGVVKIQGRKEGRNGVLQFDTEIFEITPFHHLVEMKQTSGDSLEYQKLFEQDIRPALKDIVWAWHGDDQQQMQE

SEQ ID NO: 4289 - protein, 445 aa, Panicum virgatum
MEGRGKILMERYELGRLLGKGTFGRVHYARNLESNRSVAIKMMDKDKVLKVGLSEQIRREITTMRLVAHKNIVELHEVMATRNKIYFVMEYVKGGELFDKIEKSGKLTESAAHKYFKQLISAVDYCHSRGVYHRDLKPENLLLDEDENLKVSDFGLSALSESKRQDGLLHTSCGTPAYVAPEVISKTGYDGAKSDIWSCGVVLFVLVAGHLPFQGPNLMEMYRKIQHGDFRCPSWFSHKLKKLLYKILDPNPNTRISIQKIKESTWFRKGPEGTRTVKEKIACENATTNAAPTLSVRRGKHAYEDVKLMPVTNLNAFEIISFSSGFDLSGLFIQKEHRKEARFTSDKPASAIISKIEDVAKMLNLRVRKKDNGVIKIQGRKEGRNGVLQFDTEIFEITPFHHLVEMKQTSGDSLEYQKLFEQDIRPALKDIVWAWHGDDHQQLQE

SEQ ID NO: 4290 - protein, 445 aa, Panicum virgatum
MDGTGMILMERYELGRLLGKGTFGKVHYARNLESNRSVAIKMIEKDKVLKVGLSEQIRREIATMRLAAHKNIVELHEVMATRSKIYFVMEYMKGGELFDKIEKSGKLTESAAHKYFQQLISAVDYCHSRGVYHRDLKPENLLLDEDENLKVSDFGLSALSESKRQDGLLHTTCGTPAYVAPEVISKTGYDGAKSDIWSCGVVLFVLVAGYLPFQGPNLMEMYRKIQHGDFRCPSWFSHKLKKLLYKILDPNPSTRISIQKIKESTWFRKGPERTRTVKEKIPCENATTNAAPTLSVRRGKNAYEDVKPLPVTNLNAFEIISFSSGFDLSGLFIEKEHRKDARFTSDKPASAIISKIEDVAKMLNLRVRKKDNGVVKIQGRKEGRNGVLQFDTEIFEITPFHHLVEMKQTSGDSLEYQKLFEQDIRPALKDIVWAWHGDDQQQMQE

SEQ ID NO: 4291 - protein, 443 aa, Zea mays
MESTGKILMERYEVGRLLGKGTFGKVHYAKNLESNESVAIKMMDKDKVLKAGLSEQIRREITTMRLVAHNNIVELHEVMATRNNIYFVMEYVKGGELFDKIGKSGKLTEAAAHKYFQQLIGAVDYCHSRGVYHRDLKPENLLLDENENLKVSDFGLSALSESKGQDGLLHTTCGTPAYVAPEVISKTGYDGAKSDIWSCGVVLFVLVAGYLPFRAPNMMEMYRKIQNGDFRCPSWFSHKLKKLLYKILDPSPDTRISVQKIKESTWFRKGPVETRTVKEKILSENDTTNAAPAVAMRRKKNVHEDVKPPTVTSLNAFEIISFSTGLDLSGLFIRKECKKETRFTSDKGAVSIISKLEDVAKALNLRVRKKDNGVVKIQGRKVGRKGVLEFDTEIFEIAASYHLIEMKQTGGDSLEYKKLLEEDIRPALKDIVWAWHGDDPQQK

SEQ ID NO: 4292 - protein, 445 aa, Pennisetum glaucum
MEGRGRILMERYELGRMLGQGTFGKVHYARNRDSNQSVAIKMMDKDKVLKVGLSEQIRREITTMRLVAHKNIVELHEVMATRNKIYFVMEYAKGGELFAKIEKSGKLTEAVAHKYFQQLISAVDYCHSRGVYHRDLKPENLLLDEDGNLKVSDFGLSALSESRRQDGLLHTTCGTPAYVAPEVISKIGYDGAKSDIWSCGVVLFVLVAGYLPFQGPNLMEMYRKVQHGDFRCPSWFPHKLKKLLYKILDPNPATRISIRKIKESTWFRKGPEGTRMVKEKIPCENATTNPPPALPVRRKKNPYEDAKALNVTNLNAFEIISFSSGFDLSGLFIEKECKKEARFTSDKSASAIISKIEDVAKILNLRVRKKDNGVVKIQGRKEGRNGVLQFDMEIFEITPLHHLVEMKQTSGDSLEYQKLFEEHIRPALKDIVWAWHGDDQQQKQE

SEQ ID NO: 4293 - protein, 445 aa, Pennisetum glaucum
MEGRGKVLMERYELGRMLGQGTFGKVHYARNRDSNQSVAIKVLDKDKVLKVGLSEQIRREITTMRLVAHKNIVELHEVMATRNKIYFVMEYAKGGELFKKIERSGKLTEAVAHKYFQQLISAVDYCHSRGVYHRDLKPENLLLDEDGNLKVSDFGLSALSESRRQDGLLHTTCGTPAYVAPEVISKTGYDGAKSDIWSCGVVLFVLVAGYLPFQGPNLMEMYRKVQHGDFRCPSWFPHKLKKLLYKILDPNPATRISIKKIKESTWFRKGPEGTHTVKEKIPCANATTNPAPALSVRRKKNPYGDAKALTVTNLNAFEIISFSSGFDLSGLFIEKKCKKEARFTSDKPASAIISKVSDVAKILNLRVRKKDNGVVKIQGRKEGRNGVLQFDTEIFEITPSHHLVEIKQTSGDSLEYQKLFEEHVRPALKDIVWAWHGDDQQQKQE

SEQ ID NO: 4294 - protein, 83 aa, Oryza sativa
MFLSPTISPTHTSPLESSLYSPCPQRYKSQHYVLTTNQMDCNSLAILPKVMIVDGEQHSYIIVVSESKWCRISAGKLITHIKT

SEQ ID NO: 4295 - protein, 439 aa, Oryza sativa
MESRGKILMERYELGRLLGKGTFGKVHYARNLESNQSVAIKMMDKQQVLKVGLSEQIRREITTMRLVAHKNIVQLHEVMATRNKIYFVMEYVKGGELFEKVAKRGKLTEVVAHKYFQQLISAVDYCHSRGVYHRDLKPENLLLDENENLKVSDFGLSALSESKRQDGLLHTTCGTPAYVAPEVISKIGYDGAKSDIWSCGVILFVLVAGYLPFQGPNLMEMYRKIQHGEFRCPGWFSRKLQKLLYKIMDPNPSTRISIQKIKESTWFRKGPEENRILKERTLNENTTKNVALVLGVRRKKNAHEDVKPMSVTNLNAFEIISFSKGFDLSGMFIVKEWRNEARFTSDKSASTIISKLEDVAKALNLRVRKKDNGVVKMQGRKEGRNGVLQFDIEIFEVTTSYHIIEMKQTSGDSLEYRQLLEEGIRPALKDIVLAWHGDE

SEQ ID NO: 4296 - protein, 444 aa, Triticum aestivum
MANRGKILMERYELGRLLGKGTFGKVHYARSLESNQSVAIKMLDKEKVLKVGLSEQIRREVTTMRLVAHKNIVQLHEVMATRNKIYFVMEYVKGGELFDKVAKSGKLTEGAAHKYFQQLISAVDYCHSQGVYHRDLKLENLLLDENENLKVSDFGLSALSESKRQDGLLHTTCGTPAYVAPEVISKTGYDGAKSDIWSCGVILFVLVAGYLPFHGSNLMDMYRKIEQGDFRCPSWFSHKLQKLLCKILDPNPSTRASIQKIKESTWFRKGPRGTLAVKERTPSENVTTNAPPTAGVRPRKNTHEDVQPLTVTNLNAFEIISFSTGFDLSGLFIQEDCRKETRFTSDKPASAIISKLEYVAKALNLRVRKKDNGVVKMQARKEGRNGAVQLDMEIFEITPSHHLIEMKQTSGDPLEYRELLEDIRPALKDIVWAWHGDDHQQQLE

SEQ ID NO: 4297 - protein, 444 aa, Triticum aestivum
MANRGKILMERYELGRLLGKGTFGKVHYARSLESNRSVAIKMLDKEKVLKVGLSEQIRREVTTMRLVAHKNIVQLHEVMATRNKIYFVMEYVKGGELFDKVAKSGKLTEGAAHKYFQQLISAVDYCHSQGVYHRDLKLENLLLDENENLKVSDFGLSALSESKRQDGLLHTTCGTPAYVAPEVISKTGYDGAKSDIWSCGVILFVLVAGYLPFHGSNLMDMYRKIEQGDFRCPSWFSHKLQKLLFKILDPNPSTRASIQKIKESTWFRKGPRGTLAVKERTPSENVTTNAPPTAGVRPRKNTHEDVKPLMVTNLNAFEIISFSTGFDLSGLFIREECRKETRFTSDKPASAIISKLEYVAKALNLRVRKKDNGVVKMQARKEGRNGAVQLDMEIFEITPSHHLIEMKQTSGDPLEYRELLEDIRPALKDIVWAWHGDDHHQQLE

SEQ ID NO: 4298 - protein, 434 aa, Oryza sativa
MESRGKILMERYELGRLLGKGTFGKVHYARNLESNQSVAIKMMDKQQILKVGLSEQIRREITTMRLVAHKNIVQLHEVMATRNKIYFVMEYVKGGELFEKVAKRGKLTEVVAHKYFQQLISAVDYCHSRGVYHRDLKPENLLLDENENLKVSDFGLSALSESKRQDGLLHTTCGTPAYVAPEVISKIGYDGAKSDIWSCGVILFVLVAGYLPFQGPNLMEMYRKIQHGEFRCPGWFSRKLQKLLYKIMDPNPSTRISIQKIKESTWFRKGPEENRILKERTLNENTTKNVAPVLGVRRKKNAHEDVKPMSVTNLNAFEIISFSKGFDLSGMFIVKEWRNEARFTSDKSASTIISKLEDVAKALNLRVRKKDNGVVKMQGRKEGRNGVLQFDIEIFEVTTSYHIIEMKQTSGDSLEYRQLLEEGIRPALKDIVLA

SEQ ID NO: 4299 - protein, 444 aa, Hordeum vulgare
MANRGKILMERYELGRLLGKGTFGKVHFARSLESNQSVAIKMLDKEKVLKVGLSEQIRREVTTMRLVAHKNIVQLHEVMATRNKIFFVMEYVKGGELFDKVAKSGKLTEGAAHKYFQQLISAVDYCHSQGVYHRDLKLENLLLDENENLKVSDFGLSALSESKRQDGLLHTTCGTPAYVAPEVISKTGYDGAKSDIWSCGVILFVLIAGYLPFHGSNLMEMYRKIEQGDFRCPSWFSHKLQKLLCKILDPNPSTRASIQKIKESTWFRKGPRGTLAVKERTPSENVTTNAPPTAGVRARKNTHEDVKPLMLTNLNAFEIISFSTGFDLSGLFIQEECRKETRFTSDKPASAIISKLEYVAKAMNLRVRKKDNGVVKMQTRKEGRNGAVQLDMEIFEITPSHHLIEMKQTGGDPLEYRELLEDIRPALKDIVWAWYGDDHQQRLE

SEQ ID NO: 4300 - protein, 444 aa, Secale cereale
MANRGKILMERYELGRLLGKGTFGKVHYARSLESNQSVAIKMLDKEKVLKVGLSEQIRREVTTMRLVAHKNIVQLHEVMATRNKIYFVMEYVKGGELFDKVAKSGKLTEGVAHKYFQQLISAVDYCHSQGVYHRDLKLENLLLDENENLKVSDFGLSALSESKRQDGLLHTTCGTPAYVAPEVISKTGYDGAKSDIWSCGVILFVLVAGYLPFQGSNLMDMYRKIEQGDFRCPSWFSHKLQKLLCKILDPNPSTRASIQKIKESTWFRKGPRGTLAVKERTPSENVSTNTPPTAGVRPRKNTHEHVKPLMVTNLNAFEIISFSTGFDLSGLFIQEECRKVTRFTSDKPASAIISKLEYVAKAMNLRVRKKDNGVVKMQARKEGRNGAVQLDIEIFEITPSHHLIEMKQTSGDPLEYRELLEDIRPRLKDIVWAWHGDDHQQQLE

SEQ ID NO: 4301 - protein, 442 aa, Zea mays
MKTRGKTLTERYEMGKLLGKGAFGKVHYARDLESNQGVAIKIMDKDRVLKAGLSEQVKREITTMRLVEHKNIVRLHEVMATRNKIYIIMEYAKGGELLDKVKRSGRLTEADTHRYFQQLIGALDHCHSRGVYHRDLKRENLLLDENGDLKVSDFGLSAFSESRRTDGLLHTVCGTPVYIAPEVIKKTGYDGAKSDIWSCGVVLFVLAAGYLPFQGPNMMEIYRKIHDSDFRCPSWFSHKLKRLLYKILNPNPSMRPSIQEIKESTWFRKGPREISAVKEKVLSENATATNAAPVLAARRKEIAHEDKTLVATKLNAFEIIAFSAGLDLSGLFIKECRKETRFTSDKPALAIISKLEDVAKALNLRIRKKDNNTVIIQGRKHGGNGVLQFDTQIFEITPSCHLVQMKQTSGDLLEYQKLLEEGIRPGLKDVVWAWHGDDLQQK

SEQ ID NO: 4302 - protein, 443 aa, Zea mays
MKTRGKTLTERYEMGKLLGKGAFGKVHYARDLESNQGVAIKIMDKERVLKAGLSEQVKREITTMRLVEHKNIVRLHEVMATRNKIYIIMEYAKGGELLDKVKRSGRLTEADTHRYFQQLIGALDHCHSRGVYHRDLKPENLLLNENGDLKVTDFGLSAFSESRRTDGLLHTVCGTPVYIAPEVIKKTGYDGAKSDIWSCGVVLFVLAAGYLPFQGPNLMEIYRKINDSDFRCPGWFSHKLKRLLYKILNPNPSMRPSIQEIKESTWFRKGPREISAVKEKVLSENATATNAAPVLAARRKEIAHEDMKPLVATKLNAFEIIAFSAGLDLSGLFIKECRKETRFTSDKPALAIISKLEDVAKALNLRIRKKDNNTVIIQGRKHGGNGVLQFDTQIFEITPSCHLVQMKQTSGDLIEYQKLLEEGIRPGLKDVVWAWHGDDLQQK

SEQ ID NO: 4303 - protein, 444 aa, Triticum aestivum
MANRGKILMERYELGRLLGKGTFGKVHYARSLESNRSVAIKMLDKEKVLKVGLSEQIRREVTTMRLVAHKNIVQLHEVMATRNKIYFVMEYVKGGELFDKVAKSGKLTEGAAHKYFQQLISAVDYCHSQGVYHRDLKLENLLLDENENLKVSDFGLSALSESKRQDGLLHTTCGTPAYVAPEVISKTGYDGAKSDIWSCGVILFVLVAGYLPFHGSNLMDMYRKIEQGDFRCPGWFSHKLQKLLLKILDPNPSTRASIQKIKESTWFRKGPRGTLAVKERTPSENVITNAPPTAGVRPRKNTHEDVKPLMVTNLNAFEIISFSTGFDLSGLFIQEDCRKETRFTSDKPASTIISKLEYVAKALNLRVRKKDNGVVKMQARKEGRNGAVQLDMEIFEITPSHHLIEMKQTSGDPLEYRELLEDIRPALKDIVWAWHGDDHQQQLE

SEQ ID NO: 4304 - protein, 445 aa, Zea mays
MKTRGKTLTERYELGKLLGKGAFGKVHYGRDLESNQDVAIKIMDKDRVLKAGLSEQVKCEITTMRLVTHKNIVRLHEVMATRNKIYIIMEYAKGGELFEKIKRSDRLTEADTHKYFQQLIDALDHCHSRGVYHRDLKPENLLLDENGDLKVSDFGLSAFSESRRTDGLLHTVCGTPVYIAPEVIKKTGYDGAKSDIWSCGVVLFVLAAGYLPFQGPNLMEIYRKIHDRDFRCPSWFSHKLKRLLYKILNPNPSMRPSIQEIKESTWFRKGPREISAVNEKVLSENATTTNAAPVLPSRRKEIAHEDMKSLVATNLNAFEIIALSAGLDLSGLFIKECRKETRFTSDKPALSIIAKLEDVAKALNLRIRKKDNNTISIQGRKEGGNGVLKFDTQIFEITPSCHLVQIKQTSGNLLEYEKLLEEGIRPGLKDVVSAWHGDDLQQKQK

SEQ ID NO: 4305 - protein, 1122 aa, Setaria italica
MTMMTPPPLEQQQEDEEMLVPHQELPVAGPEPAPQPMEVVAQTEPANTAESQPAEDPQTSRFTWTIESFSRLNTKKHYSDVFVVGGYKWRVLIFPKGNNVDHFSMYLDVADSGNLPYGWSRYAQFSLAVVNQIHPKYTIRKDTQHQFNARESDWGFTSFMPLSDLYDPSRGYLVNDTVVVEAEVAVRRMVDYWTYDSKKETGYVGLKNQGATCYMNSLLQTLYHIPYFRKAVYHMPTTENDMPSGSIPLALQSLFYKLQYSDNSVATKELTKSFGWDTYDSFMQHDVQELNRVLCEKLEDKMKGTVVEGTIEQLFEGHHINYIECINVDYKSSRKESFYDLQLDVKGCRDVYASFDKYVEVERLEGDNKYHAEQYGLQDAKKGVLFLDFPPVLQLQLKRFEYDYMRDTMVKINDRYEFPLQLDLDRDEGKYLSPDADRSIRNLYTLHSVLVHSGGVHGGHYYAFIRPTLSDQWYKFDDERVTKEDTKKALEEQYGGEEELPQINPGFNNTPFKFTKYSNAYMLVYIRESDKEKIMCNVDEKDIAEHLRIRLKKEQEEKEHKKKEKAEAHLYTIIKIARDEDLKDQIGKNIYFDLVDHEKVRSFRIQKQLPFTSFKEEVAKEYGIPVQFQRFWLWAKRQNHTYRPNRPLTAHEEAQSVGQLREVSNKAHNAELKLFLEVELGPELRPIRPPEKSKEDILLFFKLYDAEKEELRFVGRLFVKALGKPSEILTKLNEMAGFSPNEEIELYEEIKFEPNVMCEHIDKKLTFRSSQLEDGDIICFQKAPVPDGDTQVRYPDVPSFLEYVHNRQVVHFRSLDKPKDDDFSLELSKLHTYDDVVEKVAHQLGLDDPSKIRLTSHNCYSQQPKPQPIRYRGVEHLLDMLVHYNQTSDILYYEVLDIPLPELQCLKTLKVAFHHATKDEVVVHSIRLPKNSTISDVITDLKTKVELSNPDAELRLLEVFYHKIYKIFPPHEKIENINDQYWTLRAEEIPEEEKNLGPHDRLIHVYHFMKDPNQNQQIQNFGDPFLMVIREGETAAEVMERIQRKLRVPDEEFSKWKLAFISMNRPEYLQDTDVVSARFQRRDVYGAWEQYLGLEHTDTTSKRSYTANQNRHTYEKPVKIYN

SEQ ID NO: 4306 - protein, 1122 aa, Zea mays
MTMMTPPPLEQQQEDDEMLVPHQELPVAGPEAAPQPMEVVAQTEPATTAESQPPEDPQTTRFTWTIESFSRLNTKKHYSDVFVVGGYKWRVLIFPKGNNVDHFSMYLDVADSGNLPYGWSRYAQFSLAVVNQIHPKYTIRKDTQHQFNARESDWGFTSFMPLSDLYDPSRGYLVNDTIIVEAEVAVRRMVDYWTYDSKKETGFVGLKNQGATCYMNSLLQTLYHTPYFRKAVYHMPTTENDMPSGSIPLALQSLFYKLQYSDNSVATKELTKSFGWDTYDSFMQHDVQELNRVLCEKLEDKMKGTVVEGTIEQLFEGHHINYIECINVDYKSNRKESFYDLQLDVKGCRDVYASFDKYVEVESLEGDNKYHAERYGLQDARKGVLFLDFPPVLQLQLKRFEYDYMRDTMVKINDRYEFPLQLDLDRDNGKYLSPDADRSIRNLYTLHSVLVHSGGVHGGHYYAFIRPTLSDQWYKFDDERVTKEDTKKALEEQYGGEEELPQINPGFNNTPFKFTKYSNAYMLVYIRENDKDKIMCNVDEKDIAEHLRIRLKKEQEEKEHKKKEKSEAHLYTIIKIARDKDLKEQIGKNIYFDLVDHEKVCSFRIQKQLPFTAFQEEVAKEFGIPVQFQRFWLWAKRQNHTYRPNRPLTPHEEAQSVGQLREVSNKAHNAELKLFLEVELGPELCPIRPPEKSKEDILLFFKLYNAEKEELCFVGRLFVKALGKPSEILTKLNEMAGFSPNEEIELYEEIKFEPNVMCEHIDKKLTFRSSQLEDGDIICFQKAPVPDGDPQVRYPDVPSFLEYVHNRQVVHFRSLDKPKDDDFSLELSKLHTYDDVVERVAHKLGLDDPSKIRLTSHNCYSQQPKPQPIRYRGVEHLLDMLVHYNQTSDILYYEVLDIPLPELQCLKTLKVAFHHATKDEVVVHSIRLPRNSTISDVITDLKTKVELSNPDTELRLLEVFYHKIYKIFPPHEKIENINDQYWTLRAEEIPEEEKNLGPHDRLIHVYHFMKDPNQNQQIQNFGDPFLMVIREVETAAEVLERIQRKLRVPDEDFSKWKLAFISMNRPEYLQDTDVVSARFQRRDVYGAWEQYLGLEHTDTTSKRSYTANQNRHTYEKPVKIYN

SEQ ID NO: 4307 - protein, 1125 aa, Oryza sativa
MTMMTPPPIEQQQQEDEEMLVPHQELPAAAAVVADAVQPMEVVAQTEPANAAESQPPEDPQTSRFTWTIENFTRINGKKHYSEPFVVGGFKWRVLIFPKGNNVDHFSMYLDVADSVNLPYGWNRYAQFSLAVVNQIHPKYTIRKDTQHQFNARESDWGFTSFMPLSDLYDPSRGYLVNDTVVVEAEVAVRRMVDYWTYDSKKETGYVGLKNQGATCYMNSLLQTLYHIPYFRKAVYHMPTTENDMPSGSIPLALQSLFYKLQYSDNSVATKELTKSFGWDTYDSFMQHDVQELNRVLCEKLEDKMKETVVEGTIEQLFEGHHINYIECINVDYKSNRKESFYDLQLDVKGCSDVYASFDKYVEVERLEGDNKYHAEQYGLQDAKKGVLFLDFPPVLQLQLKRFEYDYMRDTMVKINDRYEFPLQLDLDRDDGKYLAPDADRSIRNLYTLHSVLVHSGGVHGGHYYAFIRPTLSDQWYKFDDERVTKEDTKKALEEQYGGEEELPQINPGFNNTPFKFTKYSNAYMLVYIRESDKDKIMCNVDEKDIAEHLRIRLKKEQEEKEHKKKEKAEAHLYTIIKVARDEDLKEQIGKNIYFDLVDHEKVRSFRIQKQLPFTSFKEEVAKECGIPVQFQRFWLWAKRQNHTYRPNRPLGPHEESQSVGQLREVSNKAHNAELKLFLEVETGVDLRPIRPPEKSKEDILLFFKLYNPEKEELCFVGRLFVKATGKPSEILTKLNEMAGFAPNEEIELYEEIKFEPNVMCEHIDKKLTFRSSQLEDGDIICFQKSPVSDGETQVRYPDVPSFLEYVHNRQVVHFRSLEKPKEDDFCLELSKLHTYDDVVERVARQLGLDDPSKIRLTSHNCYSQQPKPQPIRYRGVEHLLDMLVHYNQTSDILYYEVLDIPLPELQCLKTLKVAFHHATKDEVVIHSIRLPKNSTISDVITDLKTKVELSNPDAELRLLEVFYHKIYKIFPPHEKIENINDQYWTLRAEEIPEEEKNLGPHDRLIHVYHFMKDPNQNQQIQNFGDPFLLVIREGETAAEILERIQKKLRVPDEEFSKWKLAFISMNRPEYLQDVDVVSARFQRRDVYGAWEQYLGLEHTDTTPKRSYTANQNRHTFEKPVKIYN

SEQ ID NO: 4308 - protein, 1119 aa, Brachypodium distachyon
MTMMTPPPLEQQQEDEEMLVPHQELPAADAAQPMEVVAQTEPVSMAENQPPEDPQTSRFTWTIDNFTRLSGKKHYSDVFVVGGFKWRVLIFPKGNNVEHLSMYLDVADSGNLPYGWSRYAQFSLAIVNQVHQKYTTRKDTQHQFNARESDWGFTSFMPLSELYDPSRGYLLNDTVVIEAEVAVRKMVDYWTYDSKKETGYVGLKNQGATCYMNSLLQTLYHIPYFRKAVYHMPTTENDMPSGSIPLALQSLFYKLQYSDNSVATKELTKSFGWDTYDSFMQHDVQELNRVLCEKLEDKMKGTVVEGTIEQLFEGHHINYIECINVDYKSNRKESFYDLQLDVKGCRDVYASFDKYVEVESLDGDNKYQAEQHGLQDAKKGVLFLDFPPVLQLQLKRFEYDYMRDTMVKINDRYEFPLQLDLDRDDGKYLTPDADRSIRNLYTLHSVLVHSGGVHGGHYYAFIRPTLSDQWYKFDDERVTKEDTKKALEEQYGGEEELPQVNPGFNNTPFKFTKYSNAYMLVYIRESDKEKIMCNVDEKDIAEHLRIRLKKEQEEKEHKKKEKAEAHLYTIIKVARDEDLKEQIGKNIYFDLVDHEKVRSFRIQKQLPFTSFKEEVAKEYGIPVQSQRFWLWAKRQNHTYRPNRPLAPHEETQSVGQLREVSNKAHNAELKLFLEVELGLDLRPIRPPEKSKEDILLFFKLYNPEKEELRFVGRLFVKALGKPSDILTKLNEMAGFSPNEEIELYEEIKFEPHVMCEHIDKKLTFRSSQLEDGDIICFQKPSVPDADTQLRYAEVPSFLEYVHNRQVVHFRCLEKPKEDDFCLELSKLHTYDDVVERVASQLSLDDPSKIRLTSHNCYSQQPKPQPIRYRGVEHLLDMLVHYNQTSDILYYEVLDIPLPELQCLKTLKVAFHHATKEEVVIHSIRLPKNSTISDVITDLKTKVELSNTDAELRLLEVFYHKIYKIFPLQEKIENINDQYWTLRAEEIPEEEKNLAPHDRLIHVYHFMKDPNQNQQIQNFGDPFLLVIREGETASEVMERVRRKLRVLDEEFSKWKLAFISMNRPEYIQDTDVVSARFQRRDVYGAWEQYLGLEHTDTTPKRSYTANQNRHTYEKPVKIYN

SEQ ID NO: 4309 - protein, 1119 aa, Secale cereale
MTMMTPSPLEQQEEDEEMLVPHQELSAADAAQPMEVAAQTDPTNTAESQAPEDPQTSRFTWTIENFTRVSGKKHYSDVFVVGGFKWRVLIFPKGNNVDHLSMYLDVADSGLLPYGWSRYAQFSLAIVNQIHQKYTARKDTQHQFNARESDWGFTSFMPLSELYDPSRGYLVNDTVVVEAEVAVRKMVDYWTYDSKKETGYVGLKNQGATCYMNSLLQTLYHIPYFRKAVYHMPTTENDMPSGSIPLALQSLFYKLQYSDNSVATKELTKSFGWDTYDSFMQHDVQELNRVLCEKLEDKMKGTVVEGTIEQLFEGHHINYIECINVDYKSNRKESFYDLQLDVKGCRDVYASFDKYVEVERLEGDNKYQAEQHGLQDARKGVLFLDFPPVLQLQLKRFEYDYMRDTMVKINDRYEFPLQLDLDKDDGKYLTPDADRSIRNLYTLHSVLVHSGGVHGGHYYAFIRPTLSDQWYKFDDERVTKEDTKKALEEQYGGEEELPQVNPGFNNTPFKFTKYSNAYMLVYIRESDKEKIMCNVDEKDIAEHLRIRLKKEQDEKEHKKKEKAEAHLYTIIKVARDEDLKEQIGKNIYFDLVDHEKVRNFRIQKQLPFNSFKEEVAKEYGIPVQSQRFWLWAKRQNHTYRPNRPLAPHEEAQSVGQLREVSNKAHNAELKLFLEVEIGLDLRPIHPPEKSKEDILLFFKLYDPEKEELRFVGRLFVKALGKPSDILTKLNEMAGFSPNEEIELYEEIKFEPNVMCEHIDKKLSFRSSQLEDGDIISFQKPSIPGGDTQVRYKDVPSFLEYVHNRQVVHFRCLEKPKEEEFCLELSKLHTYDDVVERVARQLGLDDPSKIRLTSHNCYSQQPKPQPIRYRGVEHLLDMLVHYNQTSDILYYEVLDIPLPELQCLKTLKVAFHHATKDEVVIHSIRLSKNSTISDVITDLKTKVELSNPDAELRLLEVFYHKIYKIFPPHEKIENINDQYWTLRAEEIPEEEKNLTAQDRLIHVYHFMKDPNQNQQIQNFGDPFLLVIREGETAAEVMDRVQKKLRVPNEEFAKWKVAFISMNRPEYLQDIDAVSARFQRRDVYGAWEQYLGLEHTDTTPKRSYTANQNRHTYEKPVKIYN

SEQ ID NO: 4310 - protein, 1117 aa, Oryza sativa
MTMMTPPPLEPEEDEMLVPHQELVAADAAQPMEVVAQTEAASTAESQPAEDPQTSRFTWTIENFTRINAKKHYSDAFVVGGYKWRVLIFPKGNNVDHFSMYLDVADSANLPYGWSRYAQFSLAVVNQIQQKYTIRKDTQHQFNARESDWGFTSFMPLSELYDPSRGYLVDDTVVVEAEVAVRKMVDYWTYDSKKETGYVGLKNQGATCYMNSLLQTLYHIPYFRKAVYHMPTTENDMPSGSIPLALQSLFYKLQYSDNSVATKELTKSFGWDTYDSFMQHDVQELNRVLCEKLEDKMKRTVVEGTIEKLFEGHHINYIECINVDYKSNRKESFYDLQLDVKGCRDVYASFDKYVEVERLEGDNKYHAENHGLQDAKKGVLFLDFPPVLQLQLKRFEYDYMRDTMVKINDRYEFPLQLDLDRDDGKYLAPDADRSIRNLYALHSVLVHSGGVHGGHYYAFIRPTLSDQWYKFDDERVTKEDTKKALEEQYGGEEELPQINPGFNNAPFKFTKYSNAYMLVYIRESDKDKIMCNVDEKDIAEHLRVRLKKEQEEKEHKKKEKAEAHLYTIIKVARDENLKEQIGKDIYFDLVDHEKVRSFRIQKQLLFTTFKEEVAKEYGIPVQFQRFWLWAKRQNHTYRPNRPLSPHEETQSVGQLREVSNKAHNAELKLFLEVELGPDLRPLPPPEKSKEDILLFFKLYNPEKEELCFVGRLFVKALGKPSEILTKLNEMAGFVPNEEIELYEEIKFEPNVMCEHIDKKATFRASQLEDGDIICFQKSPIPDSDTQMRYPDVPSYLEYVHNRQVVHFRLLEKPKDDDFSLELSKLHTYDDVVERVARQLGVDDPAKIRLTSHNCYSQQPKPQPIRYRGVEHLLDMLIHYNQTSDILYYEVLDIPLPELQGLKTLKVAFHHATKDEVVIHSIRLPKNSTIADVINDLKTKVELSSPSAELRLLEVFYHKIYKIFPLHEKIENINDQYWTLRAEEIPEEEKNLGPNDRLIHVYHFMKDPLQNQQIQNFGDPFYLAIREGETLAEVKERIQKKLQVPDEEFCKWKFAFISMNRPDYLQDSDVVSARFQRRDVYGAWEQYLGLEHADTAPKRAYTANQNRHTYEKPVRIYN

SEQ ID NO: 4311 - protein, 795 aa, Triticum aestivum
MTIMTPAPLEQENDEMLVPHQELATADADTAQPMEVVAQTEAASTAESQPSEDPQTSRFTWTIASFTRLNGKKHYSDVFAVGGYKWRVLIFPKGNNVEHLSMYLDVADSANLPYGWSRSAQFSLSVVNQIDQKYTTRKDTQHQFSARESDWGFTSFMPLSELYDPSRGYLVNDTIVVEAEVAVRKMVDYWTYDSKKETGYVGLKNQGATCYMNSLLQTLYHIPYFRKAVYHMPTTENDMPSGSIPLALQSLFYKLQYSDNSVATKELTKSFGWDTYDSFMQHDVQELNRVLCEKLEDKMKGTVVEGTIEQLFEGHHINYIECINVDYKSNRKESFYDLQLDVKGCRDVYASFDKYVEVERLEGDNKYHAENHGLQDAKKGVLFLDFPPVLQLQLKRFEYDYMRDTMVKINDRYEFPLQLDLDRDDGKYLAPDADRSIRNLYTLHSVLVHSGGVHGGHYYAFIRPTLADQWYKFDDERVTKEDTKKAFEEQYGGEEELPQINPGFNNTPFKFTKYSNAYMLVYIRESDKEKIMCNVDEKDIAEHLRIRLKKEQEEKEHKKKEKAEAHLYTIIKIARDEDLKEQTGKDIYFDLVDHEKVRSFRIQKQLPFSTFKEEVAKEYGIPVQFQRFWLWAKRQNHTYRPNRPLNPHEEMQSVGQLREISNKAQNAELKLFLEVEFGLDLQPLPPPEKSKEDILLFFKLYNPEKEVLCFVGRLFVKALGKPSDILRKLTEMAGFTPDEEIELYEEIKFEPNVMCEHIDKKLTFRASQLEDGDIVCFQKSPKADSGTQVRYPDVP

SEQ ID NO: 4312 - protein, 1118 aa, Brachypodium distachyon
MTTTTPAPLEQEDEEMLVPHQEVAAVAADAAQPMEVVAQTEAVSTADSQPPEDPQTSRFTWTIQNFTRLIGKKHYSDVFVVGGYKWRVLIFPKGNNVEHLSMYLDVADSANLPYGWSRSAQFSLAIVNQIDQKYTTRKDTQHQFSARESDWGFTSFMPLSELYEPSRGYLVNDTIVVEAEVAVRKMVDYWTYDSKKETGYVGLKNQGATCYMNSLLQTLYHIPYFRKAVYHMPTTENDMPSGSIPLALQSLFYKLQYSDNSVATKELTKSFGWDTYDSFMQHDVQELNRVLCEKLEDKMKGTVVEGTIEQLFEGHHINYIECINVDYKSNRKESFYDLQLDVKGCRDVYASFDKYVEVERLEGDNKYHAENHGLQDAKKGVLFLDFPPVLQLQLKRFEYDYMRDTMVKINDRYEFPLQLDLDRDDGKYLAPDADRSIRNLYTLHSVLVHSGGVHGGHYYAFIRPTLADQWYKFDDERVTKEDTKKAFEEQYGGEEELPQINPGFNNTPFKFTKYSNAYMLVYIRESDKEKIMCNVDEKDIAEHLRIRLKKEQEEKEHKKKEKAEAHLYTIIKIARDEDLKEQTGKDIYFDLVDHEKVRSFRIQKQLPFNTFKEEIAKEYGIPVQFQRFWLWAKRQNHTYRPNRPLTPHEETQSVGQLREISNKAQNAELKLFLEVEFGLDLQPLPPPEKSKEDILLFFKLYNPEKETLCFVGRLFVKALGKPSDILRKLNEMAGFTPDEEIELYEEIKFEPNVMCEHIDKKLTFRSCQLEDGDIVCFQKSPKADSDTQVRYPDVPSFLEYVHNRQVVHFRSLEKPKDDDFCLELSKLHTYDDVVERVARQLGLDDPAKIRLTSHNCYSQQPKPQPIRYRGVEHLLDMLIHYNQTSDILYYEVLDIPLPELQFLKTLKVAFHSATKDEVVIHSIRLPKNSTIADVINDLKTKVDLSSPSAELRLLEVFYHKIYKIFPLHEKIENINDQYWTLRAEEIPEEEKNPSPHDRLIHVYHFTKDPLQNQIQNFGDPFFLAIHEGETLAQVKERIKRKLQVADEEFSKWKFAFVSMNRPDYLEDSDVVSARFQRRDVYGAWEQYLGLEHTDTAPKRAYTANQNRHTHEKPVKIYN

SEQ ID NO: 4313 - protein, 1118 aa, Sorghum bicolor
MTMVTPPTVEHEDEEMLVPAQEVAAADTDAAQPMEVVAQTEVVSTAESQPVEDPQTSRFTWTIENFTRFNGKKHYSEVFVVGGFKWRVLIFPKGNNVDHFSMYLDVADSANLPYGWSRYAQFSLAVVNQIQPKYTIRKDTQHQFNARESDWGFTSFMPLSDLYDASRGYLVNDTVVVEAEVAVRRMVDYWTYDSKKETGYVGLKNQGATCYMNSLLQTLYHIPYFRKAVYHMPTTENDMPSGSIPLALQSLFYKLQYSDSSVATKELTKSFGWDTYDSFMQHDVQELNRVLSEKLEDKMKGTVVEGTIEQLFEGHHINYIECINVEYKSNRKESFYDLQLDVKGCRDIYSSFDKYVEVERLEGDNKYHAENHGLQDAKKGVLFLDFPPVLQLQLKRFEYDYMRDTMVKINDRYEFPLQLDLDRDDGKYLAPDADRSTRNLYTLHSVLVHSGGVHGGHYYAFIRPTLSEQWYKFDDERVTKEDAKKALEEQYGGEEELPQINPGFNNAPFKFTKYSNAYMLVYIRESDKEKIMCTVDEKDIAEHLRVRLKKEQEEKEHKKKEKAEAHLYTIIKVARDEDLKEQIGKDMYFDLVDHEKVRNFRIQKQMPFSSFKEEVAKEYGIPVQFQRFWLWAKRQNHTYRPNRPLTLHEETQSVGQLREVSNKAHNAELKLFLEVEVGLDLRPLPPPEKGKEDILLFFKLYNPEKEELRFMGRLFVKALGKPSEILAKLNEMAGFSPDQEIELYEEIKFEPNVMCEIIDKKLTFRSSQLEDGDIVCFQKSPGAEYDAQVRYPDVPSFLEYVHNRQVVHFRSLEKPKDDDFSLELSKLHTYDDVVERVARQLELDDPAKIRLTSHNCYSQQPKPQPVKYRVEHLLDMLIHYNQTSDILYYEVLDIPLPELQFLKTLKVAFHHPTKDEVVIHSIRLPKNSTIADVINDLKTKVELSSPNAELRVLEVFYHKIYKIFPLQEKIENINDQYWTLRAEEIPEEEKNIGPNDRLIHVYHFMKDINQTQQIQNFGDPFFLLIHEGETLAEVKKRIQSKLQVSADEFSKWKFAFISMNRPDYLQDSDVISTRFQRREVYGAWEQYLGMEHTDTAPKRAYTVNQNRHSYEKPVKIYN

SEQ ID NO: 4314 - protein, 455 aa, Elaeis guineensis
MLNLSCFWKLSLDWICVLFLHLIRPKRILYIFFKLYDPEKEELRYVGRLFVKALGKPSDILTKLNELAGFSPNEEIELYEEIKFEPTVMCEHIDKRLTFRSSQLEDGDIICYLKSPVIDSDDQFRYPDVPSFLEYVHNRQVVHFRSLEKPKEDDFCLELSKLHTYDDVVERVAHQLGLDDPSKIRLTSHNCYSQQPKPQPIKYRGVEHLSDMLVHYNQTSDILYYEVLDIPLPELQGLKTLKVAFHHATKDEVVIHSIRLPKNSTVADVINDLKTKVELSHPNAELRLLEVFYHKIYKIFPPNEKIENINDQYWTLRAEEIPEEEKNLGPHDRLIHVYHFMKDPNQNQMQVQNFGEPFFLVIHEGETLAEVKARIQKKLQVPDDEFSKWKFAFLSLGRPEYLQDSDIVSSRFQRRDVYGAWEQYLGLEHSDTAPKRAYTANQNRHTFEKPVKIYN

SEQ ID NO: 4315 - protein, 1100 aa, Elaeis guineensis
MLVPHPEFAGGPQPMEVAPTETATTAENQQVEDPPSSRFTWTIENFSRLNTKKHYSDVFIVGSYKWRVLIFPKGNNVDHLSMYLDVADSATLPYGWSRYAQFSLAVTNQIHNKYTIRKDTQHQFNARESDWGFTSFMPLSELYDPTRGYLVNDTLVVEAEVAVRRVVDYWTYDSKKETGYVGLKNQGATCYMNSLLQTLYHIPYFRKAVYHMPTTENDMPSGSIPLALQSLFYKLQYSDSSVATKELTKSFGWDTYDSFMQHDVQELNRVLCEKLEDKMKGTVVEGTIQQLFEGHHMNYIECINVDYKSSRKESFYDLQLDVKGCRDVYASFDKYVEVERLEGDNKYHAEQYGLQDAKKGVLFIDFPPVLQLQLKRFEYDFMRDTMVKINDRYEFPLQLDLDRDNGKYLSPEADRSVRNLYTLHSVLVHSGGVHGGHYYAFIRPTLSDHWFKFDDERVTKEDMKRALEEQYGGEEELPQTNPGFNNTPFKFTKYSNAYMLVYIRESDKEKIICNVDEKDIAEHLRIRLKKEQEEKEHKKKEKAEAHLYTIIKVARDEDLAEQIGRDIYFDLVDHDKVRSFRIQKQLPFHAFKEVVAKEFVIPVQFQRFWLWAKRQNHTYRPNRPLSPQEEAQSVGQLREVSNKAHNAELKLFLEVELGLDLHPLPPPDKSKEDILLFFKLYDPEKEQLRYVGRLFVKALGKPSEILTKLNELAGYSPDEEIELYEEIKFEPSVMCEHIDTKLTFRSSQLEDGDIISYQKSPAVESDDQFRYPDVPSFLEYVRNRQVVHFRSLEKPKEDDFCLELSKLHTYDDVVERVAHHLGLNDPSKIRLTSHNCYSQQPKPQPIKYRGVEHLSDMLVHYNQTSDILYYEVLDIPLPELQGLKTLKVAFHHATKDEVVIHSIRLPKNSTVADVINDLKTKVELSHPNAELRLLEVFYHKIYKIFPPNEKIENINDQYWTLRAEEIPEEEKNLGPHDRLIHVYHFTKDTSQNQMQVQNFGEPFFLVIHEGETLAEVKVRIQKKLQVPDEEFSKWKFAFLSMGRPEYLQDSDIVSSRFQRRDVYGAWEQYLGLEHSDTAPKRAYAANQNRHTFEKPVKIYN

SEQ ID NO: 4316 - protein, 1115 aa, Musa acuminata
MTMMTPPPLEQEDEEMLVPHQEFTEGPQPMEVIPTETASAPENQQVEDPPSFKFRWTIENFSRLNVKKLYSDIFYVGAYKWRVLIFPKGNNVDHLSIYLDVADSTTLPYGWSRYAQFSLAVVNQIHGKYTVRKETQHQFNSRESDWGFTSFMSLSELYDPSRGYLVNDTCVIEAEVTVRKMVDYWSYDSKKETGYVGLKNQGATCYMNSLLQTLYHIPYFRKAVYHMPTTENDMPSGSIPLALQSLFYKLQYSDNSVATKELTKSFGWDTYDSFMQHDVQELNRVLCEKLEDKMKGTVVEGTIQHLFEGHHMNYIECINVDYKSTRKESFYDLQLDVKGCRDVYASFDKYVEVERLEGDNKYHAENYGLQDAKKGVLFIDFPPVLQLQLKRFEYDFMRDTMVKINDRYEFPLQLDLDRDNGKYLSPEADRRVRNLYTLHSVLVHSGGVHGGHYYAFIRPTLSDQWFKFDDERVTKEDAKRALEEQYGGEEELPQTNPGFNNPPFKFTKYSNAYMLVYIRESDKEKIMCNVDEKDIAEHLRVRLKKEQEEKEHKKKEKAEAHLYTIIKVARNEDLAEQIGREIFFDLVDHDKVRSFRIQKQLPFSHFKEEVAKEFGIPVQFQRFWLWAKRQNHTYRPNRPLTPQEEVQSVGQLREVSNKAHNAELKLFLEIELGPDLRPLPPPQKTKEDILLFFKLYDPEKEDLRFVGRLFVKALGKPTEILLKLNEMAGFSPNEEIELYEEIKFEPNVMCEHIDKRISFRSSQLEDGDIICYQRASALQNGDQYRYPDVPSFLEYVRNRQVVHFRSLEKPKEDDFSLELSKLSTYDDVVERVARQLGLDDPSKIRLTSHNCYSQQPKPQPIKFRGLEHLSEMLVHYNQTSDILYYEVLDIPLPELQGLKTLKVAFHHATKDEVAVHSIRLPKNSTVADVINDLKTKVELSHPDAELRLLEVFYHKIYKIFPPGEKIENINDQYWTLRAEEIPEEEKNLGPHDRLIHVYHFTRDPNQNQMQVQNFGEPFFLVIREGETLADVKIRIQKKLQVPDEEFSKWKLAFISLGRPEYLQDSDIVSNRFQRRDIYGAWEQYLGLEHSDTAPKRAYTANQNRHTFEKPVKIYN

SEQ ID NO: 4317 - protein, 1105 aa, Setaria italica
MLVPHQEVAAADADAAQPMEVVAQTEVASTAESQPAEDPQTSRFTWTIDNFTRFNGKKQYSEVFVVGGFKWRVLIFPKGNNVDHFSMYLDVADSANLPYGWSRYAQFSLAIVNQIQPKYTIRKDTQHQFNARESDWGFTSFMPLSELYDPSRGYLVNDTIVVEAEVAVRRMVDYWTYDSKKETGYVGLKNQGATCYMNSLLQTLYHIPYFRKAVYHMPTTENDMPSGSIPLALQSLFYKLQYSDSSVATKELTKSFGWDTYDSFMQHDVQELNRVLCEKLEGKMKETVVEGTIEQLFEGHHINYIECINVDYKSNRKESFYDLQLDVKGCRDVYASFDKYVEVERLEGDNKYHAENHGLQDAKKGVLFLDFPPVLQLQLKRFEYDYMRDTNVKINDRYEFPLQLDLDRDDGKYLAPDADRSTRNLYALHSVLVHSGGVHGGHYYAFIRPTLSEQWYKFDDERVTKEDAKKALEEQYGGEEELPQVNPGFNNAPFKFTKYSNAYMLVYIRESDKEKIMCTVDEKDIAEHLRVRLKKEQEDKEHKKKEKAEAHLYTIIKVARDEDLKQQIGKDIYFDLVDHEKVRNFRIQKQLPFSSFKEEVAKEYGIPVQFQRFWLWAKRQNHTYRPNRPLTPHEETQSVGQLREVSNKAHNAELKLFLEVELGLDLQPLPPPEKGREDFLLFFKLYKPETEELCFMGRLFVKALGKPSDILAKLNEMAGFSPDQEIELYEEIKFEPNVMCEIIDQKLTFRSSQLEDGDILCFQKAPRADHDTQVRYPDVPSFLEYVHNRQVVHFRSLEKPKDDDFSLELSKLHTYDDVVERVARQLELDDPAKIRLTSHNCYSQQPKPQPVKYRGVEHLLDMLIHYNQTSDILYYEVLDIPLPELQFLKTLKVAFHHPTKDEVVIHSIRLPKNSTIADVINDLKTKVELSSPNAELRVLEVFYHKIYKIFPLLEKIENINDQYWTLRAEEIPEEEKNIGPNDRLIHVYHFTKDINQTQQIQNFGDPFFLLVREGETLAEVKKRIKSKLQVSAEEFSKWKFAFISMNRPDYLQDSDVIAPRFQRREVYGAWEQYLGMEHTDTAPKRAYTVNQQNRHAYEKPVRIYN

SEQ ID NO: 4318 - protein, 1116 aa, Aristolochia fimbriata
MTMMTPPPLDQEDEEMLVPHSDFTDGPQPMEAVSQPEPASTVENQPVDDPPSSRFTWTIENFSRLNTKKHYSDIFFVGGYKWRVLIFPKGNNVDHLSMYLDVADSTQLPYGWSRYAQFSLAVINQGHPKYTIRKDTQHQFNARESDWGFTSFMPLSELYDPTRGYLVNDTCIVEAEVAVRRVVDYWTYDSKKETGYVGLKNQGATCYINSLLQTLYHIPYFRKAVYHMPTTENDMPSGSIPLALQSLFYKLQYSDNSVATKELTKSFGWDTYDSFMQHDVQELNRVLCEKLEDKMKGTVVEGTIQQLFEGHHMNYIECINVDYKSTRKESFYDLQLDVKGCRDVYASFDKYVEVERLEGDNKYHAEQHGLQEAKKGVLFIDFPPVLQLQLKRFEYDFMRDTMVKINDRYEFPLQLDLDRDNRKYLSPEADTRVRNLYTLHSVLVHSGGVHGGHYYAFIRPTLSDQWFKFDDERVTKEDMKRALEEQYGGEEELPQTNPGFNNTPFKFTKYSNAYMLVYIRESDKEKIICNVDEKDIAEHLRIRLRKEQEEKEHKKKEKAEAHLYTIIKVARDEDLSDQIGKDIYFDLVDHDKVRSFRIQKQMPFNLFKDEVAKEFGIPVQYQRFWLWAKRQNHTYRPNRPLTHQEEAQSVGQLREVSNKSHNAELKLFLEVELGPDSHPLPPPDKNKEDILLFFKLYDPEKEELRYVGRLFVKGGGKPSEILTKLNELAGFPPNEEIELYEEIKFEPSVMCEHIDKKLTFRSSQLEDGDIICFQKLPATENDKQYRYPDVPQFLEYVHNRQVVHFRSLEKPKEDDFCLELSKLFIYDDVVERVARQLGVDDPTKIRLTSHNCYSQQPKPQPIKYRGVEHLSDMLVHYNQTSDILYYEVLDIPLPELQGLKTLKVAFHHATKDEVVIHSIRLPKQSTVGDVINDLKTKVELSHPNAELRLLEVFYHKIYKIFPPNEKIENINDQYWTLRAEEIPEEEKNLGPHDRLIHVYHFTKDASQNQMQVQNFGEPFFLIIHEGETLAEVKVRIQKKLQVPDEEFAKWKFAFLSLGRPEYLQDSDIVSSRFQRRDVYGAWEQYLGLEHSDSAPKRSYPPNQNRHTFEKPVKIYN

SEQ ID NO: 4319 - protein, 1100 aa, Amborella trichopoda
MLVPHSEFNDNAQPMEVVAQGETVSTAENQPVEDPPTSRFTWTIENFSRLNSKKHYSDIFVVGGYKWRVLIFPKGNNVDHLSMYLDVADSATLPYGWSRYAQFCLSVVNQLNSKYTIRKDTQHQFNARESDWGFTSFMPLSDLYDPNKGYLVNDTVVVEAEVAVRRVVDYWTYDSKKETGYVGLKNQGATCYMNSLLQTLYHIPYFRKAVYHMPTTENDMPSGSIPLALQSLFYKLQYSDNSVATKELTKSFGWDTYDSFMQHDVQELNRVLCEKLEDKMKGTVVEGTIQQLFEGHHMNYIECINVDYKSTRKESFYDLQLDVKGCRDVYASFDKYVEVERLEGDNKYHAEQHGLQDARKGVLFIDFPPVLQLQLKRFEYDFMRDTMVKINDRYEFPLQLDLDRENGKYLSPDADRSVRNLYTLHSVLVHSGGVHGGHYYAFIRPTLSDQWFKFDDERVTKEDMKRALEEQYGGEEELPQNPGFNNTPFKFTKYSNAYMLVYIRESDKEKVICNVDEKDIAEHLRIRLKKEQEEKEHKKKEKAEAHLYTIIKVAKNEDLAEQIGKDIYFDLVDHDKVRSFRIQKQMPFSVFKEEVAKEFGVPVQFQRFWLWAKRQNHTYRPNRPLTHQEETQSVGQLREVSNKAHNAELRLFLEVEFGPDLRPILPPEKTKEDILLFFKLYDPEKEELRYVGRLFVKSSGKPIEILTKLNEMAGFPPNEEIELYEEIKFEPNVMCEHIDKKLAFRASQLEDGDIICFQKALSAENDERFRYPDVPSFLDYVHNRQVVHFRSLERPKEDDFCLELSKLYTYDDVVERVARQLGLDDPTKIRLTSHNCYSQQPKPQPIKYRGVERLSDMLVHYNQTSDILYYEVLDIPLPELQGLKTLKVAFHHSTKDEVVSHSIRLPKQSTVGDVINDLKTKVELSNSSAELRLLEVFYHKIYKIFPLGEKIENINDQYWTLRAEEIPEEEKNLSPHDRLIHVYHFTKDTTQNQMQVQNFGEPFFLVIREGETLAEVKVRIQKKLQVPDEEFSKWKFAFLSLGRPEYLQDSDVVSTRFQRRDVYGAWEQYLGLEHSDSAPKRSYTANQNRHTFEKPVKIYN

SEQ ID NO: 4320 - protein, 1115 aa, Musa acuminata
MTMMTPPPLDQEEEEMLVPHQELTEGPQPMEVTQTETATTPENQQVEDPPPFKFRWTIENFSRLNIKKLYSDIFYVGGYKWRVLIFPKGNNVDHLSIYLDVADSTTLPYGWSRYAQFTLAIVNQIHSKYTIRKETQHQFNSRESDWGFTSFMSLSELYDPSRGYLVNDTCVIEAEVAVRRLIDYWSYDSKKETGYVGLKNQGATCYMNSLLQTLYHIPYFRKAVYHMPTTENDMPSGSIPLALQSLFYKLQYSDNSVATKELTKSFGWDTYDSFMQHDVQELNRVLCEKLEDKMKGTVVEGTIQYLFEGHHMNYIECINVDYKSMRKESFYDLQLDVKGCRDIYASFDKYVEVERLEGDNKYHAENHGLQDAKKGVLFIDFPPVLQLQLKRFEYDFMRDTMVKINDRYEFPLQLDLDKDNGKYLSPEADRRVRNLYTLHSVLVHSGGVHGGHYYAFIRPTLSDQWFKFDDERVTKEDVKRALEEQYGGEEELSQTNPGFNNTPFKFTKYSNAYMLVYIRESDKEKIMCNVDEKDIAEHLRVRLKREQEEKEHKKKEKAEAHLYTIIKVARNEDLAEQIGREIFFDLVDHDKVRTFRIQKQLPFSHFKEEVAKEFNIPVQFQRFWLWAKRQNHTYRPNRPLTPQEEAQSVGQLREVSNKAHNAELKLFLEVELGLDLHPLPPPQKTKEDILLFFKLYDPEKEGLRFVGRLFVKALGKPIEILSKLNEMAGFPPNEDIELYEEIKFEPSVMCEHIDKQIPFRSSQLEDGDIICYQKASTLGNIDQYRYPDIPSFLEYVHNRQVVHFRSLEKPKEDDFSLELSKLFTYDDVVERVARQLGVDDPSKIRLTSHNCYSQQPKPQPIKYRGVEHLSDMLVHYNQTSDILYYEVLDIPLPELQGLKTLKVAFHHATKDEVAVHSIRLPKNSTVADVINDLKTKVELSHPDAELRLLEVFYHKIYKIFPLGEKIENINDQYWTLRAEEIPEEEKNLSPHDRLIHVYHFTRDPNQNQMQVQNFGEPFFLVIREGETLADVKMHIQKKLQVPDDEYSKWKFAFVSLGRPEYLQDLDVVSNRFQRRDIYGAWEQYLGLEHPDTAPKRAYTVNQNRHTFEKPVKIYN

SEQ ID NO: 4321 - protein, 1118 aa, Glycine max
MTVMTPAPIDQQQEDEEMLVPHTDLAENNHQPMEVVAQPDAANTVESQPVEDPSTSRFTWKIENFSRMNTKKLYSEIFVVGGYKWRVLIFPKGNNVDYLSMYLDVADSASLPYGWSRYAQFSLAVVNQIHNKYSVRKDTQHQFNARESDWGFTSFMPLGELYDPSRGYLVNDTLVVEAEVLVRRIVDYWTYDSKKETGYVGLKNQGATCYMNSLLQTLYHIPYFRKAVYHMPTTENDMPSGSIPLALQSLFYKLQYSDTSVATKELTKSFGWDTYDSFMQHDVQELNRVLCEKLEDKMKGTVVEGTIQKLFEGHHMNYIECINVDYKSTRKESFYDLQLDVKGCPDVYASFDKYVEVERLEGDNKYHAEQYGLQDAKKGVLFIDFPPVLQLQLKRFEYDFMRDTMVKINDRYEFPLQLDLDRENGKYLSPDADRNVRNLYTLHSVLVHSGGVHGGHYYAFIRPTLSEQWYKFDDERVTKEDTKRALEEQYGGEEELPQTNPGFNNTPFKFTKYSNAYMLVYIREADKDKVICNVDEKDIAEHLRERLKKEQEEKEHKKKEKAEAHLYTIIKVARDEDLAEQIGKDIYFDLVDHDKVRSFRVQKQTSFNLFKDEVAKEFGIPVQFQRFWLWAKRQNHTYRPNRPLTHMEEAQSVGQLREVSNKVHNAELKLFLEVELGLDLRPIAPPDKTKDDILLFFKLYDTEKEELRYVGRLFVKATGKPSEILTRLNKMAGYDPDEEIGLYEEIKFEPNVMCEPIDKKVTFRASQLEDGDIICFQKAPAIDNEHVRYPDVPSYLEYVHNRQVVHFRSLEKPKEDDFCLEMSRLYTYDDVVEKVAQQLGLDDPSIIRLTPHNCYSQQPKPQPIKYRGVEHLSDMLVHYNQTSDILYYEVLDIPLPELQGLKTLKVAFHHATKDEVVIHTIRLPKQSTVGDVLNDLKTKVELSDPEAELRLLEVFYHKIYKVFPPNEKIESINDQYWTLRAEEIPEEEKNLGPHDRLIHVYHFTKDTAQNQMQIQNFGEPFFLVIHEGETLAEIKVRIQKKLQVPDDEFVKWKFAFFSLGRPEYLQDSDIVSSRFQRRDVYGAWEQYLGLEHTDNAPKRSYAVNQNRHTFEKPVKIYN

SEQ ID NO: 4322 - protein, 1119 aa, Cajanus cajan
MTVMTPAPIDQQEDEEMLVPSHTDSAENNHQPMEVVAQPDAVNTVENQPVEDPTSSRFTWRIDGFSRMNTKKLYSDVFVVGGFKWRVLIFPKGNNVDYLSMYLDVADSASLPYGWSRYAQFSLAVVNQIHNKYSVRKDTQHQFNARESDWGFTSFMPLGELYDPSRGYLVNDTLVVEAEVLVRRIVDYWTYDSKKETGYVGLKNQGATCYMNSLLQTLYHIPYFRKAVYHMPTTENDMPSGSIPLALQSLFYKLQYSDTSVATKELTKSFGWDTYDSFMQHDVQELNRVLCEKLEDKMKGTVVEGTIQKLFEGHHMNYIECINVDYKSTRKESFYDLQLDVKGCPDVYASFDKYVEVERLEGDNKYHAEQYGLQDAKKGVLFIDFPPVLQLQLKRFEYDFMRDTMVKINDRYEFPLQLDLDRENGKYLSPDADRNVRNLYTLHSVLVHSGGVHGGHYYAFIRPTLSEQWYKFDDERVTKEDTKRALEEQYGGEEELPQTNPGFNNTPFKFTKYSNAYMLVYIREADKEKVICNVDEKDIAEHLRERLKKEQEEKEHKKKEKAEAHLYTIIKVARDEDLTQQIGKDIYFDLVDHDKVRSFRVQKQTSFNLFKEEVAKEFGIPVQFQRFWLWAKRQNHTYRPNRPLTHMEEAQSVGQLREVSNKVHNAELKLFLEVELGPDLRPIAPPDKTKDDILLFFKLYDPEKEELSYVGRMFVKSTGKPSEILTKLNKMAGYDPDEEIGLYEEIKFEPNVMCEPIDKKVTFRASQLEDGDIICFQKAPAIDSEEHVRYPDVPSYLEYVHNRQVVHFRSLDKPKEDDFCLEMSRLFTYDDVVERVAQQLGLDDPSIIRLTPHNCYSQQPKPQPIKYRGVEHLSDMLVHYNQTSDILYYEVLDIPLPELQGLKTLKVAFHHATKEEVVIHTIRLPKQSTVGDVLDDLKTKVELSDPEAELRLLEVFYHKIYKVFPPNEKIENINDQYWTLRAEEIPEEEKNLGPHDRLIHVYHFTKDTAQNQMQIQNFGEPFFLVIREGETLSEIKVRIQKKLQVPDDEFVKWKFAFFSLGRPEYLQDSDIVSSRFQRRDVYGAWEQYLGLEHTDNAPKRSYAVNQNRHTFEKPVKIYN

SEQ ID NO: 4323 - protein, 1118 aa, Glycine max
MTVMTPAPIDQQQEDEEMLVPHTDLAENNHQPMEVVAQPDAANTVESQPVEDPSTSRFTWKIDNFSRMNTKKLYSEIFVVGGYKWRVLIFPKGNNVDYLSMYLDVADSASLPYGWSRYAQFSLAVVNQIHNKYSVRKDTQHQFNARESDWGFTSFMPLGELYDPSRGYLVNDTLVVEAEVLVRRIVDYWTYDSKKETGYVGLKNQGATCYMNSLLQTLYHIPYFRKAVYHMPTTENDMPSGSIPLALQSLFYKLQYSDTSVATKELTKSFGWDTYDSFMQHDVQELNRVLCEKLEDKMKGTVVEGTIQKLFEGHHMNYIECINVDYKSTRKESFYDLQLDVKGCPDVYASFDKYVEVERLEGDNKYHAEQYGLQDAKKGVLFIDFPPVLQLQLKRFEYDFMRDTMVKINDRYEFPLQLDLDRENGKYLSPDADRNVRNLYTLHSVLVHSGGVHGGHYYAFIRPTLSEQWYKFDDERVTKEDTKRALEEQYGGEEELPQTNPGFNNTPFKFTKYSNAYMLVYIREADKDKVICNVDEKDIAEHLRERLKKEQEEKEHKKKEKAEAHLYTIIKVARDEDLAEQIGKDIYFDLVDHDKVRSFRVQKQTSFNLFKEEVAKEFGIPVQFQRFWLWAKRQNHTYRPNRPLTHMEEAQSVGQLREVSNKVHNAELKLFLEVELGLDVCPIAPPDKTKDDILLFFKLYDPEKEELRYAGRLFVKSTGKPSEILTRLNKMAGYDPDEEIGLYEEIKFEPNVMCEPIDKKLTFRASQLEDGDIVCFQKAPAIDSEHVRYPDVPSYLEYVHNRQVVHFRSLEKPKEDDFCLEMSRLYTYDDVVEKVAQQLGLEDPSIIRLTPHNCYSQQPKPQPIKYRGVDHLSDMLVHYNQTSDILYYEVLDIPLPELQGLKTLKVAFHHATKDEVVIHTIRLPKQSTVGDVLDDLKTKVELSDPEAELRLLEVFYHKIYKVFPPNEKIESINDQYWTLRAEEIPEEEKNLGPHDRLIHVYHFTKDTAQNQMQIQNFGEPFFLVIHEGETLAEIKVRIQKKLQVPDDEFVKWKFAFFSLGRPEYLQDSDIVSSRFQRRDVYGAWEQYLGLEHTDNAPKRSYAVNQNRHTFEKPVKIYN

SEQ ID NO: 4324 - protein, 1116 aa, Fragaria vesca
MTVMTPAPIDQPEDEEMLVPPSDLPENNHQPMEVVAQPENANNVETQPVEDPPSSRFTWRIDNFSRMNTKKLYSDIFVVGGYKWRVLIFPKGNNVDHLSMYLDVADSTNLPYGWSRYAQFSLGVINQVHNKYSVRKDTQHQFNARESDWGFTSFMPLGELYDPSRGYLVNDAVIIEAEVLVRRVVDYWTYDSKKETGFVGLKNQGATCYMNSLLQTLYHIPYFRKAVYHMPTTENDLPSQSIPLALQSLFYKLQYSDNSVATKELTKSFGWDTYDSFMQHDVQELNRVLCEKLEDKMKGTVVEGTIQQLFEGHHMNYIECINVDYKSTRKESFYDLQLDVKGCRDVYASFDKYVEVERLEGDNKYHAEQNGLQDAKKGVLFIDFPPVLQLQLKRFEYDFMRDTMVKINDRYEFPLQLDLDRENGKYLSPEADRSVRNLYTLHSVLVHSGGVHGGHYYAFIRPTLSDQWYKFDDERVTKEDIKRALEEQYGGEEELPQTNPGFNNTPFKFTKYSNAYMLVYIRETDKDKIICNVDEKDIAEHLRERLKKEQEEKEHKKKEKAEAHLYTIIKVARDENLLEQIGKDIYFDLVDHDKVKSFRIQKQMPFNLFKEEVAKEFGIPVQFQRFWLWAKRQNHTYRPNRPLTPVEETQSVGQLREVSNKVHNAELKLFLEIELGLDLHPIAPPDKTKDDILLFFKLYEPEKEELRYVGRLFVKSTGKPAEILSKLNELAGYAPDEEIDLYEEIKYEPTVMCEPIDKKFTFRASQLEDGDIVCFQKPNPDENQFRYPDVPSFLDFVHNRLVVHFRSFEKPKEDDFSLELSKLHTYDDVVERVAQQLGLDDPSKIRLTSHNCYSQQPKPQPIKYRGVERLTDMLVHYNQTSDILYYEVLDIPLPELQGLKTLKVAFHHATKDEVVIHTIRLPKQSTVGDVINDLKTKVELSHPDAELRLLEVFYHKIYKVFPQSEKIENINDQYWTLRAEEVPEEEKNLGPNDRVIHVYHFTKDTAQNQMQIQNFGEPFFLVIREGETLDEIRVRIQKKLQVADEEFAKWKFAFLSLGRPEYLQDTDIVSSRFQRRDVYGAWEQYLGLEHSDSTPKRSYAANQNRHTYEKPVKIYN

SEQ ID NO: 4325 - protein, 1118 aa, Lotus japonicus
MTVMTPAPIDQQEDEEMLVPHTDLPENNHQPMEVVAQPEAAPTVESQPVEEPPQSRFTWRIDNFSRMNVKKLYSEVFVVGGYKWRVLIFPKGNNVDYLSMYLDVADSTNLPYGWSRYAQFSLAVVNQIQNKYTVRKDTQHQFNARESDWGFTSFMPLGELYDPSRGYLLNDTLVVEAEVLVRRIVDYWTYDSKKETGYVGLKNQGATCYMNSLLQTLYHIPYFRKAVYHMPTTENDMPAGSIPLALQSLFYKLQYSDTSVATKELTKSFGWDTYDSFMQHDVQELNRVLCEKLEDKMKGTVVEGTIQKLFEGHHMNYIECINVDYKSTRKESFYDLQLDVKGCHDVYASFDKYVEVEPLEGDNKYHAEQYGLQDAKKGVLFIDFPPVLQLQLKRFEYDFMRDTMVKINDRYEFPLELDLDRDDGKYLSPDADRNVRNLYTLHSVLVHSGGVHGGHYYAFIRPTLSDQWYKFDDERVTKEDTKRALEEQYGGEEELPQTNPGFNNTPFKFTKYSNAYMLVYIREADKDKVICNVDEKDIAEHLRERLKKEQEEKEHKKKEKAEAHLYTIIKVARNEDLKEQIGKDIYFDLVDHDKVRSFRVQKQMSFNLFKEEVAKEFGIPVQFQRFWLWAKRQNHTYRPNRPLTPAEEAQSVGQVREVSNKVHNAELKLFLEVELGPDLRPIAPSDKTKDDILLFFKLYDPEKEELRYVGRLFVKSTGKPSEILTRLNEMAGYDPDEEIGLYEEIKFEPNVMCEPIDKKLTFRASQLEDGDIICFQKAPAMDSEEHVRYPDVPSYLEYVHNRQVVHFRSLDKPKEDDFCLEMSRLYTYDDVVEKVAQQLNLDDPSKIRLTPHNCYSQQPKPQPIKYRGVDHLSDMLVHYNQTSDILYYEILDIPLPELQGLKTLKVAFYHATKDEVVSHTIRLPKQSTVGDVLDDLKTKVELSHPNAELRLLEVFYHKIYKVFPPNEKIETINDQYWTLRAEEVPEEEKNLGPHDRLIHVYHFTKDTSQNQMQIQNFGEPFFLVIREGETLTEIKVRIQKKLQVPDDEFEKWKFAFFALGRPEYLQDSDIVSNRFQRRDVYGAWEQYLGLEHTDNAPKRSYAVNQNRHTFEKPVKIYN

SEQ ID NO: 4326 - protein, 1123 aa, Medicago truncatula
MTIMTPAPIDQQQQEDEEMLVPHAVPHADLAENNNHQPMDVVAQPETANTVEPVEDPSPSRFTWRIDNFSRVNLKKLYSDVFVVGSYKWRVLIFPKGNNVDYLSMYLDVADSTSLPYGWSRYAQFSLAVVNQIHNKYTVRKDTQHQFNARESDWGFTSFMPLGELYDPSRGYLMNDTLIIEAEVLVRRIVDYWTYDSKKETGYVGLKNQGATCYMNSLLQTLYHIPYFRKAVYHMPTTENDMPSGSIPLALQSLFYKLQYSDTSVATKELTKSFGWDTYDSFLQHDVQELNRVLCEKLEDKMKATVVEGTIQKLFEGHHMNYIECINVDYKSTRKESFYDLQLDVKGCPDVYASFDKYVEVERLEGDNKYHAEQYGLQDAKKGVLFIDFPPVLQLQLKRFEYDFMRDTMVKINDRYEFPLQLDLDRDNGKYLSPDADRNVRNLYTLHSVLVHSGGVHGGHYYAFIRPTLSDQWYKFDDERVTKEDPKRAMEEQYGGEEELPQTNPGFNNTPFKFTKYSNAYMLVYIREADKEKVICNVDEKDIAEHLRERLKKEQEEKEHKKKEKAEAHLYTIIKVARDEDLGEQIGKDIYFDLVEHDKVRSFRVQKQTPFNVFKEEVAKEFGIPVQFQRFWLWAKRQNHTYRPNRPLTQIEEAQSVGQLREISNKVHNAELKLFLEVERGPDLCPIAPPEKTKDDILLFFKLYDPEKEELRFVGRLFVNNTGKPSEILARLNKMAGYDPEEEIGLYEEIKFEPNVMCEPIDKKLTFRASQLEDGDIICFQKAPATDNEEHIRYPDVPSYLEYVHNRQVVHFRSLDKPKEDDFCLEMSRLFTYDDVVERVAEQLGLDDPSKIRLTPHNCYSQQPKPQPIKYRGVEHLSDMLVHYNQTSDILYYEVLDIPLPELQGLKTLKVAFHHATKDEVVIHTIRLPKQSTVGDVLEDLKKKVELSRPDAELRLLEVFYHKIYKVFPPNEKIENINDQYWTLRAEEIPEEEKNLGPHDRLIHVYHFTKDTTQNQMQIQNFGEPFFLVIHECETLAEIRLRIQKKLQVPDDEFGKWKFAFFSLGRPEYLEDSEVVSNRFQRRDVYGAWEQYLGLEHTDNAPKRSYAANQNRHTFEKPVKIYN

SEQ ID NO: 4327 - protein, 154 aa, Papaver somniferum
MTLMTPPPLDQEDDEMLVPHSEFVEGPQPMEVATAEAVSTVENQPVEDPASSRFTWTIENFSRLNTKKHYSDVFTVGAYKWRVLIFPKGNNVDHLSMYLDVADSANLPYGWSRYAQFSLAIVNQIHNKYTVRKDTQHQFTARESDLGFYIVHAS

SEQ ID NO: 4328 - protein, 573 aa, Ricinus communis
MLKKEQEEKEQKRKEKAEAHLYTIIKVARSEDLLEQIGKDIYFDLVDHDKVRSFRIQKQMPFNLFKEEVVKEFGIPVQFQRFWLWAKRQNHTYRPNRPLTPQEEAQSVGQLREVSNKANNAELKLFLEVEFGQDLRPIPPPEKTKEDILLFFKLYDPSKEELRYVGRLFVKGAGKPLEILTKLNEMAGFASDQEIELYEEIKFEPNVMCEHIDKKLTFRASQLEDGDIVCFQKSAQDGGGEQCRYPDVPSFLEYVHNRQVVRFRSLEKPKEDEFCLELSKLHNYDDVVERVATHLGLDDPSKIRLTSHNCYSQQPKPQPIKYRGVDHLSDMLAHYNQTSDILYYEVLDIPLPELQGLKTLKVAFHHATKDEVVIHTIRLPKQSTVGDVINDLKIKVELSHLSAELRLLEVFYHKIYKIFPHNEKIENINDQYWTLRAEEIPEEEKNLGPNDRLIHVYHFMKDPTQNQQVQNFGEPFFLVIHEGETLSEVKVRVQKKLQVPDEEFAKWKFAFLSLGRPEYLQDSDIVSSRFQRRDVYGAWEQYLGLEHSDNAPKRSYSANQNRHTFEKPVKIYN

SEQ ID NO: 4329 - protein, 1117 aa, Gossypium hirsutum
MTVMAPAPIDQQEDEEMLVPQSDLTDNHQPMEVVAQPEAANTVENQPVEDPPSSRFTWRIENFSRLNAKKHYSEVFVVGGYKWRILLFPKGNNVDHLSMYLDVADSASLPYGWSRYAQFSLAVVNQIHNKYSIRKDTQHQFNARESDWGFTSFMPLGELYDPCRGYLVNDTLIVEAEVVVRRIVDYWTYDSKKETGYVGLKNQGATCYMNSLLQTLYHIPYFRKAVYHMPTTENDMPSGSIPLALQSLFYKLQYSDSSVATKELTKSFGWDTHDSFMQHDVQELNRVLCEKLEDKMKGTVVEGTIQQLFEGHHMNYIECINVDYKSTRKESFYDLQLDVKGCHDVYASFDKYVEVERLEGDNKYHAEQYGLQDAKKGVLFIDFPPVLQLQLKRFEYDFMRDTMVKINDRYEFPLQLDLDRDGGKYLSPDADRRVRNLYTLHSVLVHSGGVHGGHYYAFIRPTLSDQWYKFDDERVTKEDMKRALEEQYGGEEELPQTNPGFNNTPFKFTKYSNAYMLVYIRESDKDKIICNVDEKDIAEHLRERLKKEQEEKEHKKKEKAEAHLYTIIKVARDDDLAEQIGKDIYFDLVDHDKVRSFRIQKQITFNVFKEEIAKEFGIPVQFQRFWLWAKRQNHTYRPNRPLTPLEETQSVGTLREVSNKVHNAELRLFLEVELGLDLRPIAPPDKTKEDILLFFKHYNPEKEELRFVGRLFVKSTGKPIEILSKLNKMAGYAPDEEINLYEEIKFEPSVMCEPIDKKITFRASQLEDGDIVCFQKSLPVESIEQFRYPDVPSFLEYVHNRQIVHFRSLEKPKEDDFCLEMSRLYTYDDVVERVAQQLGLNDPSKIRLTSHNCYSQQPKPQPIKYRGVDHLSDMLVHYNQTSDILYYEVLDIPLPELQGLKTLKVAFHHATKDEVVIHTIRLPKQSTVGDVINDLKTKVELSHPDAELRLLEVFYHKIYKIFPPSEKIENINDQYWTLRAEEIPEEEKNLGPNDRLIHVYHFTKETAQNQMQILNFGEPFFLVIHEGETLAEIKVRIQKKLQVPDEDFAKWKFAFLSLGRPEYLQDSDIVSSRFQRRDVYGAWEQYLGLEHSDNAPKRAYAANQNRHTFEKPVKIYN

SEQ ID NO: 4330 - protein, 1117 aa, Gossypium raimondii
MTVMAPAPIDQQEDEEMLVPQSDLTDNHQPMEVVAQPEAANTVENQPVEDPPSSRFTWRIENFSRLNAKKHYSEVFVVGGYKWRILLFPKGNNVDHLSMYLDVADSASLPYGWSRYAQFSLAVVNQIHNKYSIRKDTQHQFNARESDWGFTSFMPLGELYDPCRGYLVNDTLIVEAEVVVRRIVDYWTYDSKKETGYVGLKNQGATCYMNSLLQTLYHIPYFRKAVYHMPTTENDMPSGSIPLALQSLFYKLQYSDSSVATKELTKSFGWDTHDSFMQHDVQELNRVLCEKLEDKMKGTVVEGTIQQLFEGHHMNYIECINVDYKSTRKESFYDLQLDVKGCHDVYASFDKYVEVERLEGDNKYHAEQYGLQDAKKGVLFIDFPPVLQLQLKRFEYDFMRDTMVKINDRYEFPLQLDLDRDGGKYLSPDADRRVRNLYTLHSVLVHSGGVHGGHYYAFIRPTLSDQWYKFDDERVTKEDMKRALEEQYGGEEELPQTNPGFNNTPFKFTKYSNAYMLVYIRESDKDKIICNVDEKDIAEHLRERLKKEQEEKEHKKKEKAEAHLYTIIKVARDDDLAGQIGKDIYFDLVDHDKVRSFRIQKQITFNVFKEEIAKEFGIPVQFQRFWLWAKRQNHTYRPNRPLTPLEETQSVGTLREVSNKVHNAELRLFLEVELGLDLRPIAPPDKTKEDILLFFKHYNPEKEELRFVGRLFVKSTGKPIEILSKLNKMAGYAPDEEINLYEEIKFEPSVMCEPIDKKITFRASQLEDGDIVCFQKSLPVESIEQFRYPDVPSFLEYVHNRQIVHFRSLEKPKEDDFCLEMSRLYTYDDVVERVAQQLGLNDPSKIRLTSHNCYSQQPKPQPIKYRGVDHLSDMLVHYNQTSDILYYEVLDIPLPELQGLKTLKVAFHHATKDEVVIHTIRLPKQSTVGDVINDLKTKVELSHPDAELRLLEVFYHKIYKIFPPSEKIENINDQYWTLRAEEIPEEEKNLGPNDRLIHVYHFTKETAQNQMQILNFGEPFFLVIHEGETLAEIKVRIQKKLQVPDEDFAKWKFAFLSLGRPEYLQDSDIVSSRFQRRDVYGAWEQYLGLEHSDNAPKRAYAANQNRHTFEKPVKIYN

SEQ ID NO: 4331 - protein, 1129 aa, Glycine max
MTVMTPAPIDQQQEDEEMLVPHTDLAENNHQPMEVVAQPDAANTVESQPVEDPSTSRFTWKIENFSRMNTKKLYSEIFVVGGYKWRVLIFPKGNNVDYLSMYLDVADSASLPYGWSRYAQFSLAVVNQIHNKYSVRKDTQHQFNARESDWGFTSFMPLGELYDPSRGYLVNDTLVVEAEVLVRRIVDYWTYDSKKETGYVGLKNQGATCYMNSLLQTLYHIPYFRKAVYHMPTTENDMPSGSIPLALQSLFYKLQYSDTSVATKELTKSFGWDTYDSFMQHDVQELNRVLCEKLEDKMKGTVVEGTIQKLFEGHHMNYIECINVDYKSTRKESFYDLQLDVKGCPDVYASFDKYVEVERLEGDNKYHAEQYGLQVGCNCLFWNLLDAKKGVLFIDFPPVLQLQLKRFEYDFMRDTMVKINDRYEFPLQLDLDRENGKYLSPDADRNVRNLYTLHSVLVHSGGVHGGHYYAFIRPTLSEQWYKFDDERVTKEDTKRALEEQYGGEEELPQTNPGFNNTPFKFTKYSNAYMLVYIREADKDKVICNVDEKDIAEHLRERLKKEQEEKEHKKKEKAEAHLYTIIKVARDEDLAEQIGKDIYFDLVDHDKVRSFRVQKQTSFNLFKDEVAKEFGIPVQFQRFWLWAKRQNHTYRPNRPLTHMEEAQSVGQLREVSNKVHNAELKLFLEVELGLDLRPIAPPDKTKDDILLFFKLYDTEKEELRYVGRLFVKATGKPSEILTRLNKMAGYDPDEEIGLYEEIKFEPNVMCEPIDKKVTFRASQLEDGDIICFQKAPAIDNEHVRYPDVPSYLEYVHNRQVVHFRSLEKPKEDDFCLEMSRLYTYDDVVEKVAQQLGLDDPSIIRLTPHNCYSQQPKPQPIKYRGVEHLSDMLVHYNQTSDILYYEVLDIPLPELQGLKTLKVAFHHATKDEVVIHTIRLPKQSTVGDVLNDLKTKVELSDPEAELRLLEVFYHKIYKVFPPNEKIESINDQYWTLRAEEIPEEEKNLGPHDRLIHVYHFTKDTAQNQMQIQNFGEPFFLVIHEGETLAEIKVRIQKKLQVPDDEFVKWKFAFFSLGRPEYLQDSDIVSSRFQRRDVYGAWEQYLGLEHTDNAPKRSYAVNQNRHTFEKPVKIYN

SEQ ID NO: 4332 - protein, 1118 aa, Citrullus lanatus
MTVMTPAPVDQQEDEEMLVPHSDLAENNHQPMEVVPQSETGNTVENQPVEDPPSSRFTWRIDNFTRLNIKKLYSEIFIVGGYKWRILIFPKGNNVDHLSMYLDVADSASLPYGWSRYAQFSLGVINQIHNKYSVRKDTQHQFNARESDWGFTSFMPLSELYDPTRGYLVNDTLIVEAEVLVRRVVDYWTYDSKKETGFVGLKNQGATCYMNSLLQTLYHIPYFRKAVYHMPTTENDMPSASIPLALQSLFYKLQYSDSSVATKELTKSFGWDTYDSFMQHDVQELNRVLSEKLEDKMKGTVVEGTIQKLFEGHHMNYIECINVDYKSTRKESFYDLQLDVKGCRDVYASFDKYVEVERLEGDNKYHAEQYGLQDAKKGVLFIDFPPVLQLQLKRFEYDFMRDTMVKINDRYEFPLQLDLDRENGKYLSPEADRTVRNLYTLHSVLVHSGGVHGGHYYAFIRPTLSEQWYKFDDERVTKEDVKRALEEQYGGEEELPQTNPGFNNTPFKFTKYSNAYMLVYIRESDKDKVICNVDEKDIAEHLRERLKKEQEEKEHKKKEKAEAHLYTIIKVARDEDLVEQIGKDIFFDLVDHDKVRSFRIQKQMPFNLFKEEVAKEFGIPIQFQRYWLWAKRQNHTYRPNRPLTPMEEAQSVGQLREVSNKVHNAELKLLLEVEYGLDSRPIAPPDKTKDDILLFFKLYEPEKEELRYVGRLFVKGNGKPFEILTKLNEMAGYAPEEEIELYEEIKFEPNIMCEPIDKKFTFRASQLEDGDIVCFQKSPPVENAEQYRYPDVPSFLEYVHNRQVVHFRSLEKPKEDDFCLEMSKLYTYDDVVERLAQQLGVDDPSKIRLTSHNCYSQQPKPQPIKYRGVEHLSDMLVHYNQTSDILYYEVLDIPLPELQGLKTLKVAFHHATKDEVVIHTIRLPKQSTVADVINDLKTKVELSHPDAELRLLEVFYHKIYKVFPPNEKIENINDQYWTLRAEEIPEEEKNLGPNDRLIHVYHFTKDTSQNQMQIQNFGEPFFLVINEGETLADIKLRIQKKLQVPDEEFAKWKFAFLSLGRPEYLQDTDIVSNRFQRRDVYGAWEQYLGLEHTDNAPKRAYTANQNRHTFEKPVKIYN

SEQ ID NO: 4333 - protein, 1118 aa, Prunus persica
MTVMTPAPIDQPEDEEMLVPHSDLPENNHQPMEVVAQPETANNVENQPVEDPPSSRFTWRIDNFSRMNTKKLYSDIFVVGGYKWRVLIFPKGNNVDHLSMYLDVADSASLPYGWSRYAQFCLGLVNQIHNKYSVRKDTQHQFNARESDWGFTSFMPLSDLYDPSRGYLVNDTLIIEAEVLVRRVVDYWTYDSKKETGYVGLKNQGATCYMNSLLQTLYHIPYFRKAVYHMPTTENDLPSQSIPLALQSLFYKLQYSDNSVATKELTKSFGWDTYDSFMQHDVQELNRVLCEKLEDKMKGTVVEGTIQKLFEGHHMNYIECINVDYKSTRKESFYDLQLDVKGCRDVYASFDKYVEVERLEGDNKYHAEQYGLQDAKKGVLFIDFPPVLQLQLKRFEYDFMRDTMVKINDRYEFPLQLDLDRENGKYLSPEADRSVRNLYTLHSVLVHSGGVHGGHYYAFIRPTLSDQWYKFDDERVTKEDIKRALEEQYGGEEELPQTNPGFNNTPFKFTKYSNAYMLVYIRESDKDKIICNVDEQDIAEHLRERLKKEQEEKEHKKKEKAEAHLYTIIKVARDENLVEQIGKDIYFDLVDHDKVRSFRIQKQTPFNVFKEEVAKEIGIPVQFLRFWLWAKRQNHTYRPNRPLTPVEETQSVGQLREVSNKVHNAELKLFLEVELGLDLHPIAPPDKTKDDILLFFKLYDPEKEELRYVGRLFVKSTGKAAEILSKLNEMAGYAPEEEIDLYEEIKFEPNVMCEPIDKKFTFRACQLEDGDIVCFQKPTPVENGEHLRYPDVPSFLDYVHNRQVVHFRSLEKPKEDDFSLELSKLHTYDDVVERVAQQLGLDDPSKIRLTSHNCYSQQPKPQPIKYRGVERLTDMLVHYNQTTDILYYEVLDIPLPELQGLKTLKVAFHHATKEEVVIHTIRLPKQSTVGDVINDLKTKVELSHPDAELRLLEVFYHKIYKVFPHSEKIENINDQYWTLRAEEVPDEEKNLGPNDRVIHVYHFTKDTAQNQMQIQNFGEPFFLVIHEGETLAEIKARVQKKLQVADEEFAKWKFAFLSLGRPEYLQDSDIVSSRFQRRDVYGAWEQYLGLEHSDSAPKRAYAANQNRHTFEKPVKIYN

SEQ ID NO: 4334 - protein, 1126 aa, Glycine max
MTVMTPAPIDQQQEDEEMLVPHTDLAENNHQPMEVVAQPDAANTVESQPVEDPSTSRFTWKIDNFSRMNTKKLYSEIFVVGGYKWRVLIFPKGNNVDYLSMYLDVADSASLPYGWSRYAQFGWSRYAQFSLAVVNQIHNKYSVRKDTQHQFNARESDWGFTSFMPLGELYDPSRGYLVNDTLVVEAEVLVRRIVDYWTYDSKKETGYVGLKNQGATCYMNSLLQTLYHIPYFRKAVYHMPTTENDMPSGSIPLALQSLFYKLQYSDTSVATKELTKSFGWDTYDSFMQHDVQELNRVLCEKLEDKMKGTVVEGTIQKLFEGHHMNYIECINVDYKSTRKESFYDLQLDVKGCPDVYASFDKYVEVERLEGDNKYHAEQYGLQDAKKGVLFIDFPPVLQLQLKRFEYDFMRDTMVKINDRYEFPLQLDLDRENGKYLSPDADRNVRNLYTLHSVLVHSGGVHGGHYYAFIRPTLSEQWYKFDDERVTKEDTKRALEEQYGGEEELPQTNPGFNNTPFKFTKYSNAYMLVYIREADKDKVICNVDEKDIAEHLRERLKKEQEEKEHKKKEKAEAHLYTIIKVARDEDLAEQIGKDIYFDLVDHDKVRSFRVQKQTSFNLFKEEVAKEFGIPVQFQRFWLWAKRQNHTYRPNRPLTHMEEAQSVGQLREVSNKVHNAELKLFLEVELGLDVCPIAPPDKTKDDILLFFKLYDPEKEELRYAGRLFVKSTGKPSEILTRLNKMAGYDPDEEIGLYEEIKFEPNVMCEPIDKKLTFRASQLEDGDIVCFQKAPAIDSEHVRYPDVPSYLEYVHNRQVVHFRSLEKPKEDDFCLEMSRLYTYDDVVEKVAQQLGLEDPSIIRLTPHNCYSQQPKPQPIKYRGVDHLSDMLVHYNQTSDILYYEVLDIPLPELQGLKTLKVAFHHATKDEVVIHTIRLPKQSTVGDVLDDLKTKVELSDPEAELRLLEVFYHKIYKVFPPNEKIESINDQYWTLRAEEIPEEEKNLGPHDRLIHVYHFTKDTAQNQMQIQNFGEPFFLVIHEGETLAEIKVRIQKKLQVPDDEFVKWKFAFFSLGRPEYLQDSDIVSSRFQRRDVYGAWEQYLGLEHTDNAPKRSYAVNQNRHTFEKPVKIYN

SEQ ID NO: 4335 - protein, 1124 aa, Trigonella foenum-graecum
MTVMTPAPIDQQQQQEDEEMLVPHAVPHADLAENNNHQPMDVVAQPETANTVEPVEDPSPSRFTWRIDNFSRVNTKKLYSDVFVVGSYKWRVLIFPKGNNVDYLSMYLDVADSTSLPYGWSRYAQFSLAVVNQIHNKYTVRKDTQHQFNARESDWGFTSFMPLGELYDPNRGYLMNDSIIIEAEVLVRRIVDYWTYDSKKETGYVGLKNQGATCYMNSLLQTLYHIPYFRKAVYHMPTTENDMPSGSIPLALQSLFYKLQYSDTSVATKELTKSFGWDTYDSFLQHDVQELNRVLCEKLEDKMKATVVEGTIQKLFEGHHMNYIECINVDYKSTRKESFYDLQLDVKGCPDVYASFDKYVEVERLEGDNKYHAEQYGLQDAKKGVLFIDFPPVLQLQLKRFEYDFMRDTMVKINDRYEFPLQLDLDRDNGKYLSPDADRNVRNLYTLHSVLVHSGGVHGGHYYAFIRPTLTDQWYKFDDERVTKEDPKRAMEEQYGGEEELPQTNPGFNNTPFKFTKYSNAYMLVYIREADKEKVICNVDEKDIAEHLRERLKKEQEEKEHKKKEKAEAHLYTIIKVARDEDLGEQIGKDIYFDLVDHDKVRSFRVQKQTPFNVFKEEVAKEFGIPVQFQRFWLWAKRQNHTYRPNRPLTHIEEAQSVGQLREISNKVHNAELKLFLEVERGPDLCPIAPPEKTKDDILLFFKLYDPEKEELRYVGRVFVNSTGKPSEILTRLNKMAGHDPDEEIGLYEEIKFEPNVMCEPIDKKLTFRASQLEDGDIICFQKVLAMDNEEHIRYPDVPSYLEYVHNRQVVHFRSLDKPKEDDFCLEMSRLFTYDDVVERVAEQLGLDDPSKIRLTPHNCYSQQPKPQPIKYRGVEHLSDMLAHYNQTSDILYYEVLDIPLPELQGLKTLKVAFHHATTDEVVIHTIRLPKQSTVGDVLDDLKKKVELSRPDAELRLLEVFYHKIYKVFPPNEKIENINDQYWTLRAEEIPEEEKNLGPHDRLIHVYHFTKDTTQNQMQIQNFGEPFFLVIHECETLAEIRVRLQKKLQVPDEEFVKWKFAFFSLGRPEYLEDSDVVSNRFQRRDVYGAWEQYLGLEHTDTAPKRSYAANQNRHTFEKPVKIYN

SEQ ID NO: 4336 - protein, 1118 aa, Phaseolus vulgaris
MTVMMPAPIDQQEDEEVLVPHTDLPENNHQPMEVVAQPETANAVESQPVEDPPSSRFTWRIENFSRLNTKKLYSEQFVVGGYKWRVLIFPKGNNVDYLSMYLDVADSASLPYGWSRYAQFSLAVVNQIHNKYSVRKDTQHQFNARESDWGFTSFMPLGELYDPSRGYLVNDTLIVEAEVLVRRIVDYWTYDSKKETGYVGLKNQGATCYMNSLLQTLYHIPYFRKAVYHMPTTENDMPSGSIPLALQSLFYKLQYSDTSVATKELTKSFGWDTYDSFMQHDVQELNRVLCEKLEDKMKGTVVEGTIQKLFEGHHMNYIECINVDYKSTRKESFYDLQLDVKGCRDVYASFDKYVEVERLEGDNKYHAEQYGLQDAKKGVLFVEFPPVLQLQLKRFEYDFMRDTMVKINDRYEFPLQLDLDRDDGKYLSPDADRTVRNLYTLHSVLVHSGGVHGGHYYAFIRPTLSEQWYKFDDERVTKEDNKRALEEQYGGEEELPQATPGFNNTPFKFTKYSNAYMLVYIRESDKDKIICNVDEKDIAAHLRERLKKEQEEKEHKKKEKAEAHLYTIIKVARDEDLKVQIGKAIYFDLVDHDKVRSFRVQKQTSFNLFKEEVAKEFDVPVQFQRYWIWAKRQNHTYRPNRPLTPAEEAQSVGQLREVSNKVHNAELKLFLEVEMGMDSRPIAPPEKTKDDLLLFFKLYDPEKEELRYVGRIFVKCTGKPLEILTRLNEMAGYDPEEDIALYEEIKFEPNVMCEPIDKKVTFRTSQLEDGDIICFQKASSMDIGDNVRYPDVPSYLEYVHNRQVVHFRSLERPKEDDFFLEMSRLFTYDDVVERVAQQLGLDDPSKIRLTPHNCYSQQPKPQPIKYRGVEHLSDMLVHYNQTSDILYYEVLDIPLPELQGLKTLKVAFHHAIKDEVVIHTIRLPKQSTVGDVLDDLKTKVELSDPKAELRLLEVFYHKIYKVFPPNEKIENINDQYWTLRAEEIPDEEKSLGPHDRLIHVYHFNKDTAQNQMQIQNFGEPFFLVIHEGETLSEIKVRIQKKLQVPDDEFGKWKFAFLSLGRPEYLQDSDIVSSRFQRRDVYGAWEQYLGLEHTDNAPKRSYAVNQNRHTFEKPVKIYN

SEQ ID NO: 4337 - protein, 1118 aa, Phaseolus vulgaris
MTVMTPAPIDQQEDEEMLVPHTDLPENNHQPMEVVAQPDAANTVESQPVEDPSSTRFTWKIDNFSRMNSKKLYSEIFVVGGYKWRVLIFPKGNNVDYLSMYLDVADSSNLPYGWSRYAQFSLAVINQIHNKYSVRKDTQHQFNARESDWGFTSFMPLGELYDPTRGYLVNDTLVVEAEVLVRRIVDYWTYDSKKETGYVGLKNQGATCYMNSLLQTLYHIPYFRKAVYHMPTTENDMPSASIPLALQSLFYKLQYSDTSVATKELTKSFGWDTYDSFMQHDVQELNRVLSEKLEDKMKGTVVEGTIQKLFEGHHMNYIECINVDYKSTRKESFYDLQLDVKGCPDVYASFDKYVEVERLEGDNKYHAEQYGLQDAKKGVLFIDFPPVLQLQLKRFEYDFMRDTMVKINDRYEFPMQLDLDRENGKYLSPEADRNVRNLYTLHSVLVHSGGVHGGHYYAFIRPTLSEQWYKFDDERVTKEDTKRALEEQYGGEEELPQTNPGFNNTPFKFTKYSNAYMLVYIREADKDKVICNVDEKDIAEHLRERLKKEQEEKEHKKKEKAEAHLYTIIKVARDEDLGEQLGKDIYFDLVDHAKVRSFRVQKQISFNFFKEEVAKEFGIPVQFQRFWLWAKRQNHTYRPNRPLTLMEEAQSVGQLREVSNKVPNAELKLFLEVELGLDLRPIAPPDKTKDDILLFFKLYDPEKEELRYVGRLFVKNTGKPLEILTKLNKMAGYDPDEEIGLYEEIKFEPNVMCEPIDKKLTFRASQLEDGDIICFQKAPAIYNVEHVRYPDVPSYLEYVHNRQVVHFRSLDKPKEDDFCLEMSRLYKYDDVVERVAQQLGLDDPSIIRLTPHNCYSQQPKPQPVKYRGVEHLSEMLVHYNQTSDILYYEVLDIPLPELQGLKTLKVAFHHATKDEVVIHTTRLPKQSTVGDVLDDLKTKVELSDPEAELRLLEVFYHKIYKVFPPNEKIENINDQYWTLRAEEIPEEEKNLGPHDRLIHVYHFTKDTAQNQMQIQNFGEPFFLVIHEGETLTEIKVRIQKKLQVPDDEFAKWKFAFFSLGRPEYLQDSDIVSSRFQRRDVYGAWEQYLGLEHTDNAPKRSYAVNQNRHTFEKPVKIYN

SEQ ID NO: 4338 - protein, 1115 aa, Populus trichocarpa
MTMMTPSPLDQEDEEMLVPHSDLVEGPQPIEVAQVEQTSTVENQPVEDPPSMKFTWTIENFTRLNTKKHYSDVFIVGSYKWRVLIFPKGNNVDHLSMYLDVADSTTLPYGWSRYAQFSLAVVNQIHNKYSIRKDTQHQFNARESDWGFTSFMPLSELYDPSRGYLVNDTVVIEAEVAVRKLLDYWSYDSKKETGYVGLKNQGATCYMNSLLQTQYHIPYFRKAVYHMPTTENDMPTGSIPLALQSLFYKLQYNDTSVATKELTKSFGWDTYDSFMQHDVQELNRVLCEKLEDKMKGTVVEGTIQQLFEGHHMNYIECINVDYKSTRKESFYDLQLDVKGCRDVYASFDKYVEVERLEGDNKYHAEEHGLQDAKKGVLFIDFPPVLQLQLKRFEYDFMRDTMVKINDRYEFPLQLDLDRENGKYLSPDADRSVRNLYTLHSVLVHSGGVHGGHYYAFIRPTLSDQWFKFDDERVTKEDMKRALEEQYGGEEELPQTNPGFNNTPFKFTKYSNAYMLVYIRESDKDKIICNVDEKDIAEHLRIRLKKEQEEKEDKRRYKAQAHLYTIIKVARDEDLKEQIGKDIYFDLVDHDKVHNFRIQKQMQFSLFKEEVAKEFGIPVQFQRFWIWAKRQNHTYRPNRSLTPQEEAQSVGQLREVSNKTHNAELKLFLEIELGLDLRPIAPPEKTKEDILLFFKLYDPEKQELRYVGRLFVKSSGKPIEILAKLNQMAGFPPDEEIELYEEIKFEPCVMCEHLDNRASFRISQIEDGDIICFQKSPPLEKEEECRYPDVPSYLEYVHNRQIVHFRSLEKPKEDDFCLELSKVHTYDDVVERVARQIGLDDPSKIRLTSHNCYSQQPKPQPIKYRGVEHLSDMLVHYNQTSDILYYEVLDIPLPELQGLKNLKVAFHHAIKDEVVIHNIRLPKQSTVGDVINELKTKVELSHPNAELRLLEVFYHKIYKIFPPNEKIENINDQYWTLRAEEIPEEEKNLGPQDRLIHVYHFTKESGQNQMQVQNFGEPFFLVIHEGETLAQVKMRIQKKLQVPDEEFAKWKFAFLSLGRPEYLQDSDVVFTRFQRRDVYGAWEQYLGLEHPDNTPKRSYAVNQNRHTFEKPVKIYN

SEQ ID NO: 4339 - protein, 1118 aa, Phaseolus vulgaris
MTVMTPAPIDQQEDEEMLVPHTDLPENNHQPMEVVAQPDAANTVESQPVEDPSSTRFTWKIDNFSRMNSKKLYSEIFVVGGYKWRVLIFPKGNNVDYLSMYLDVADSSNLPYGWSRYAQFSLAVINQIHNKYSVRKDTQHQFNARESDWGFTSFMPLGELYDPTRGYLVNDTLVVEAEVLVRRIVDYWTYDSKKETGYVGLKNQGATCYMNSLLQTLYHIPYFRKAVYHMPTTENDMPSASIPLALQSLFYKLQYSDTSVATKELTKSFGWDTYDSFMQHDVQELNRVLSEKLEDKMKGTVVEGTIQKLFEGHHMNYIECINVDYKSTRKESFYDLQLDVKGCRDVYASFDKYVEVERLEGDNKYHAEQYGLQDAKKGVLFVEFPPVLQLQLKRFEYDFMRDTMVKINDRYEFPMQLDLDRENGKYLSPEADRNVRNLYTLHSVLVHSGGVHGGHYYAFIRPTLSEQWYKFDDERVTKEDTKRALEEQYGGEEELPQTNPGFNNTPFKFTKYSNAYMLVYIREADKDKVICNVDEKDIAEHLRERLKKEQEEKEHKKKEKAEAHLYTIIKVARDEDLGEQLGKDIYFDLVDHAKVRSFRVQKQISFNFFKEEVAKEFGIPVQFQRFWLWAKRQNHTYRPNRPLTLMEEAQSVGQLREVSNKVPNAELKLFLEVELGLDLRPIAPPDKTKDDILLFFKLYDPEKEELRYVGRLFVKNTGKPLEILTKLNKMAGYDPDEEIGLYEEIKFEPNVMCEPIDKKLTFRASQLEDGDIICFQKAPAIYNVEHVRYPDVPSYLEYVHNRQVVHFRSLDKPKEDDFCLEMSRLYKYDDVVERVAQQLGLDDPSIIRLTPHNCYSQQPKPQPVKYRGVEHLSEMLVHYNQTSDILYYEVLDIPLPELQGLKTLKVAFHHATKDEVVIHTTRLPKQSTVGDVLDDLKTKVELSDPEAELRLLEVFYHKIYKVFPPNEKIENINDQYWTLRAEEIPEEEKNLGPHDRLIHVYHFTKDTAQNQMQIQNFGEPFFLVIHEGETLTEIKVRIQKKLQVPDDEFAKWKFAFFSLGRPEYLQDSDIVSSRFQRRDVYGAWEQYLGLEHTDNAPKRSYAVNQNRHTFEKPVKIYN

SEQ ID NO: 4340 - protein, 1114 aa, Manihot esculenta
MTMMTPPPLDQEDEEMLVPHSDLVEGPQPMEVAQVESASTVENQPVEDPPSMKFSWTIQNFSRLNTKKHYSDVFIVGGYKWRILIFPKGNNVDHLSMYLDVADSATLPYGWSRYAQFSLAVVNQIHNKYSIKKDTQHQFNGRESDWGFTSFMPLSDLYDPSRGYLVNDIVVVEAEVAVRKVLDYWSYDSKKETGYVGLKNQGATCYMNSLLQTLYHIPYFRKAVYHMPTTENDMPTGSIPLALQSLFYKLQYNDTSVATKELTKSFGWDTYDSFMQHDVQELNRVLCEKLEDKMKGTVVEGTIQQLFEGHHMNYIECINVDYKSTRKESFYDLQLDVKGCRDVYASFDKYVEVERLEGDNKYHAEEHGLQDAKKGVLFIDFPPVLQLQLKRFEYDFMRDTMVKINDRYEFPLQLDLDRENGKYLSPEADRSVRNLYTLHSVLVHSGGVHGGHYYAFIRPTLSDQWFKFDDERVTKEDMKRALEEQYGGEEELPQTNPGFNNAPFKFTKYSNAYMLVYIRECDKDKIICNVDEKDIAEHLRIRLKKEQEEKEDKRRYKAQAHLYTIIKVARDEDLKEQIGRDIYFDLVDHDKVRNFRIQKQTPFSHFKEEVTKEFGVPVQFQRFWIWAKRQNHTYRPNRPLTPQEEAQSVGQLREVSNKAHTAELKLFLEVELGQDLRPIAPPDKTKEDILLFFKLYDPEKGELRYVGRLFVKSSGKPMEILAKLNQMAGFAPDEEIELYEEIKFDPCVMCEHLDKRTSFRLSQIEDGDIICFQKSPPLEGEEDCRYPDVPSFLEYVHNRQVVHFRSLEKPKEDDFCLELSKLHTYDDVVERVAQQIGLDDPSKIRLTSHNCYSQQPKPQPIKYRGVDHLSDMLVHYNQTSDILYYEVLDIPLPELQGLKNLKVAFHHATKDEVVIHNIRLPKQSTVGDVINELKTKVELSHPNAELRLLEVFYHKIYKIFPPNEKIENINDQYWTLRAEEAKEEKNLGPHDRLIHVYHFTKETAQNQMQVQNFGEPFFLVIHEGETLAEVKARIQKKLQVPDEDFSKWKFAFLSLGRPEYLQDSDIVFTRFQRRDVYGAWEQYLGLEHSDNTPKRSYAVNQNRHTFEKPVKIYN

SEQ ID NO: 4341 - protein, 1116 aa, Populus trichocarpa
MTLMTPPPLDQQEDDEMLVPHTEFTEGPQPMEVAQAETATAVDAQSVDDPPSARFTWTIDNFSRFNTKKLYSDVFVVGGYKWRILVFPKGNNVDHLSMYLDVADSTNLPYGWSRYAQFSLTVINQLHQKYSIRKDTQHQFNARESDWGFTSFMPLGELYDPGRGYLVNDSCIVEADVAVRRVIDYWSHDSKKETGYVGLKNQGATCYMNSLLQTLYHIPYFRKAVYHMPTTENDIPSGSIPLALQSLFYKLQYSDTSVATKELTKSFGWDTYDSFMQHDVQELNRVLSEKLEDKMKGTVVEGTIQQLFEGHHMNYIECINVDYKSTRKESFYDLQLDVKGCRDVYASFDKYVEVERLEGDNKYHAEQHGLQDARKGVLFIDFPPVLQLQLKRFEYDFMRDTMVKINDRYEFPLQLDLDRENGKYLSPEADCSVRNLYTLHSVLVHSGGVHGGHYYAYIRPTLSDQWFKFDDERVTKEDVKRALEEQYGGEEELPQTNPGFNNSPFKFTKYSNAYMLVYIRESDKEKVICNVDEKDIAEHLRIRLKKEQEEKEQKRKEKAEAHLYTIIKVARSEDLLEQIGKDVYFDLVDHDKVRSFRIQKQITFNLFKEEVAKEFGIPVQFQRFWLWAKRQNHTYRPNRPLTPQEESQSVGQLREVSNKANNAELKLFLEVEVGQDSRPVPPPEKTKEDILLFFKLYDPSKEELRYVGRLFVKGSGKPLEILTKLNEMAGFAPDQEIELYEEIKFEPNVMCEHIDKRLTFRSSQLEDGDIVCFQKPPQMGSNEQCRYPDVPSFLEYMHNRQVVRFRSLEKSKEDEFCLELSKLHTYDDVVERVANHLGLDDPSKIRLTSHNCYSQQPKPQPIKYRGVDHLSDMLVHYNQTSDILYYEVLDIPLPELQGLKTLKVAFHHATKDEVVIHTIRLPKQSTVGDVINDLKTKVELSHPSAELRLLEVFYHKIYKIFPHNEKIENINDQYWTLRAEEIPEEEKNLGPHDRLIHVYHFMKDTTQNQVQVQNFGEPFFLVIHEGEALADVKMRVQRKLQVPDEEFSKWKFAFLSLGRPEYLQDSDIVSNRFQRRDIYGAWEQYLGLEHSDNAPKRSYAANQNRHTFEKPVKIYN

SEQ ID NO: 4342 - protein, 425 aa, Triticum aestivum
VADSGNLPYGWSRYAQFSLAVVNQIHQKYTARKDTQHQFNARESDWGFTSFMPLSELYDPSRGYLVNDTVVVEAEVAVRKMVDYWTYDSKKETGYVGLKNQGATCYMNSLLQTLYHIPYFRKAVYHMPTTENDMPSGSIPLALQSLFYKLQYSDNSVATKELTKSFGWDTYDSFMQHDVQELNRVLCEKLEDKMKGTVVEGTIEQLFEGHHINYIECINVDYKSNRKESFYDLQLDVKGCRDVYASFDKYVEVERLEGDNKYQAEQHGLQDARKGVLFLDFPPVLQLQLKRFEYDYMRDTMVKINDRYEFPLQLDLDKDDGKYLTPDADRSIRNLYTLHSVLVHSGGVHGGHYYAFIRPTLSDQWYKFDDERVTKEDTKKTLEEQYGARKSCLKLTLVSITPHLSSQSIQMPTCLYIFVRVTRRK

SEQ ID NO: 4343 - protein, 1115 aa, Musa acuminata
MTMTTPPPLDQEEDELLVPRPEIAEGPQPMEVAQSETTSTAENHQVEEPSSSRFTWTIENFSRLNTKKLYSDMFIVGGYQWRVLIFPKGNNVDYLSMYLDVADSASLPYGWSRFAQFSLAVVNQIQSKYSIRKDTQHQFNSRESDWGFTSFMPLSEVYDPSRGFLVNDTIVVEADVAVRRVIDYWSYDSKKETGYVGLKNQGATCYMNSLLQTLYHIPYFRKAVYHMPTTENDMPSGSIPLALQSLFYKLQYSDGSVATKDLTKSFGWDTYDSFMQHDVQELNRVLCEKLEDKMKGTVVEGTIQQLFEGHHTNYIECINVDYKSSRKESFYDLQLDVKGCHDVYASFDKFVEVERLEGDNKYHAEQYGLQDAKKGVLFADFPPVLQLQLKRFEYDFMRDTMIKINDRYEFPVQLDLDRENGKYLSPDADRRVRNLYTIHSVLVHSGGVHGGHYYAFIRPNLSDQWYKFDDERVTKEDTKRAIEEQYGGEEELPQINPGFNNTPFKFTKYSNAYMLVYIRESDKDKIMCNVDEKDIAEHLRIRLKREQEEKEQKKKEKAEAHLYTIIKVARDKDLMEQIGRDIYFDLVDHDKVCSFRIQKQLPFSIFKEEVAREFGIPVHFQRFWLWAKRQNHTYRPNRPLSPQEEAQSVGQLREISNKAQNAELKLLLEVELGPDLHPSPPPEKTKEDILLFFKLYDPEKEELRYLGRLFVKGLGKPADILTKLNEMAGFSPNEEIELFEEIKFEPNVMCERIDKRLPFRSSQLEDGDIICYQKSPSLGNNEPIRYPDVPSFLEYVRNRQVVHFRLLEKPKEDDFCLELSKLDTYDDVVEKVARQLSLNDPSKIRLTSHNCYSQQPKPQPIKYRGVDHLSDMLVHFTQTSDILYYEVLDIPLPELQGLKTLKVAFHHATKDEVAIHSIRLPKNSIVGDVINDLKAKVELSHPNAELRLLEVFYHKIYKIFPPSEKIENINDQYWTLRAEEIPEEEKNLGPQDRLIHVYHFMKDPNQNQMQIQNFGEPFLLVIHEGETLAEVKVRIQKKLQIPDDDFSKWKFAFLSMGRPDYLQDSEIVSNRFQRRDVYGAWEQYLGLEHSDTAPKRAYTANQNRHTFDKPVRIYN

SEQ ID NO: 4344 - protein, 1115 aa, Euphorbia peplus
MTMMTPPPLDQEDEEMLVPHSDLVEGPQPMEVAQVEPASTVENQPVEDPPSMKFTWTIENFTRLNTKKHYSDMFVVGGYKWRVLIFPKGNNVDHLSMYLDVADSSTLPYGWSRYAQFSLAVVNQAHNKYSIRKDTQHQFNARESDWGFTSFMPLSDLYDPTRGYLVNDTVIVEAEVAVRKVLDYWSYDSKKETGFVGLKNQGATCYMNSLLQTLYHIPYFRKAVYHMPTTENDMPTGSIPLALQSLFYKLQYNDTSVATKELTKSFGWDTYDSFMQHDVQELNRVLCEKLEDKMKGTVVEGTIQQLFEGHHMNYIACINVDYKSTRKESFYDLQLDVKGCRDVYASFDKYVEVERLEGDNKYHAEEHGLQDAKKGVLFIDFPPVLQLQLKRFEYDFMRDTMVKINDRYEFPLQLDLDREDGKYLSPEADRSVRNLYTLHSVLVHSGGVHGGHYYAFIRPTLTDQWFKFDDERVTKEDVKRALEEQYGGEEELPQTNPGFNNAPFKFTKYSNAYMLVYIRESDKDKIICNVDEKDIAEHLRIRLKKEQEEKEDKRRYKAQAHLYTIIKVARDEDLKEQIGRDIYFDLVDHDKVRNFRIQKQTPFNIFKEEVAKEFGVPVQFQRFWIWAKRQNHTYRPNRPLTPQEEAQSVGQLREVSNKAHNAELKLFLEVELGLDLHPIAPPDKTKEDILLFFKFYDPEKGELRYVGRLFVKSSGKPMEILSKINQMAGFAPDEEIELYEEIKFEPCVMCEHLDKRTSFRLSQIEDGDIICFQKSSPVETEEDCRYPDVPAFLEYVHNRQVVHFRSLEKPKDDDFCLELSKQHTYDDVVERVARQIGLDDPSKIRLTSHNCYSQQPKPQPVKYRGVEHLSDMLAHYNQTSDILYYEVLDIPLPELQGLKNLKVAFHHATKDEVVIHNIRLPKQSTVGDVINELKTKVDLSHPNAELRLLEVFYHKIYKIFPPNEKIENINDQYWTLRAEEIPEEEKNLGPHDRLIHVYHFTKETAQNQMQVQNFGEPFFLVIHEGETLAEVKLRIQKKLQVPDEEFAKWKFAFLSLGRPEYLLDADIVFTRFQRRDVYGAWEQYLGLEHSDNTPKRSYAVNQNRHTFEKPVKIYN

SEQ ID NO: 4345 - protein, 1116 aa, Populus trichocarpa
MTLMTPPPLDQQEDDEMLVPHTEFTEGPQPMEVAQAETATAVDAQSVDDPPSARFTWTIDNFSRFNTKKLYSDVFVVGGYKWRILVFPKGNNVDHLSMYLDVADSTNLPYGWSRYAQFSLTVINQLHQKYSIRKDTQHQFNARESDWGFTSFMPLGELYDPGRGYLVNDSCIVEADVAVRRVIDYWSHDSKKETGYVGLKNQGATCYMNSLLQTLYHIPYFRKAVYHMPTTENDIPSGSIPLALQSLFYKLQYSDTSVATKELTKSFGWDTYDSFMQHDVQELNRVLSEKLEDKMKGTVVEGTIQQLFEGHHMNYIECINVDYKSTRKESFYDLQLDVKGCRDVYASFDKYVEVERLEGDNKYHAEQHGLQDARKGVLFIDFPPVLQLQLKRFEYDFMRDTMVKINDRYEFPLQLDLDRENGKYLSPEADCSVRNLYTLHSVLVHSGGVHGGHYYAYIRPTLSDQWFKFDDERVTKEDVKRALEEQYGGEEELPQTNPGFNNSPFKFTKYSNAYMLVYIRESDKEKVICNVDEKDIAEHLRIRLKKEQEEKEQKRKEKAEAHLYTIIKVARSEDLLEQIGKDVYFDLVDHDKVRSFRIQKQITFNLFKEEVAKEFGIPVQFQRFWLWAKRQNHTYRPNRPLTPQEESQSVGQLREVSNKANNAELKLFLEVEVGQDSRPVPPPEKTKEDILLFFKLYDPSKEKLRYVGRLFVKGSGKPLEILTKLNEMAGFAPDQEIELYEEIKFEPNVMCEHIDKRLTFRSSQLEDGDIVCFQKPPQMGSNEQCRYPDVPSFLEYMHNRQVVRFRSLEKSKEDEFCLELSKLHTYDDVVERVANHLGLDDPSKIRLTSHNCYSQQPKPQPIKYRGVDHLSDMLVHYNQTSDILYYEVLDIPLPELQGLKTLKVAFHHATKDEVVIHTIRLPKQSTVGDVINDLKTKVELSHPSAELRLLEVFYHKIYKIFPHNEKIENINDQYWTLRAEEIPEEEKNLGPHDRLIHVYHFMKDTTQNQVQVQNFGEPFFLVIHEGEALADVKMRVQRKLQVPDEEFSKWKFAFLSLGRPEYLQDSDIVSNRFQRRDIYGAWEQYLGLEHSDNAPKRSYAANQNRHTFEKPVKIYN

SEQ ID NO: 4346 - protein, 1118 aa, Cicer arietinum
MTVMMSAPIDQQEDEEVLVPHADLPDNNHQPMEVVAQPEAANTVESQPVSDPPQSRFTWRIDNFTRLNTKKLYSEVFVVGSYKWRVLIFPKGNNVDYLSMYLDVADSASLPYGWSRYAQFSLAIVNQIHSKYSVRKDTQHQFNARESDWGFTSFMPLGELYDPSRGYLVNDTLIIEAEVLVRKIVDYWNYDSKKETGYVGLKNQGATCYMNSLLQTLYHIPYFRKAVYHMPTTENDMPSGSIPLALQSLFYKLQYSDTSVATKELTKSFGWDTYDSFMQHDVQELNRVLCEKLEDKMKGTVVEGTIQKLFEGHHMNYIECINVDYKSTRKESFYDLQLDVKGCRDVYASFDKYVEVERLEGDNKYHAEQYGLQDAKKGVLFIDFPPVLQLQLKRFEYDFMRDTMVKINDRYEFPLQLDLDRENGKYLSPDADRSVRNLYTLHSVLVHSGGVHGGHYYAFIRPTLSEQWYKFDDERVTKEDNKRALEEQYGGEEELPQTNPGFNNTPFKFTKYSNAYMLVYIRESDKDKIICNVDEKDIAEHLRERLKKEQEEKEHKKKEKAEAHLYTIIKVARDEDIEVQMGKDIYFDLVDHDKVRSFRVQKQTPFNVFKEEVAKEFGVPVQFQRFWLWAKRQNHTYRPNRPLTHAEEAQTVGQLREVSNKVHNAELKLFLEVEKGMDLCPIAPPDKTKDDILLFFKLYDPEKEELRYVGRLFVKCTGKPSEIITRLNEMAGYDPEEDIALYEEIKFEPNVMCEPIDKKVTFRASQLEDGDIVCFQKALAIDSEEQVRYPDVPSYLEYVHNRQVVHFRSLDRPKEDDFSLEMSRLYTYDDVVERVAQQLGLDDPSKIRLTPHNCYSQQPKPQPIKYRGVDHLSDMLVHYNQTSDILYYEVLDIPLPELQGLKTLKVAFHHAIKDEVVSHTIRLPKQSTVGDVLDDLKTKVELSHTDAELRLLEVFYHKIYKVFPSNEKIENINDQYWTLRAEEIPEEEKNIGQQDRLIHVYHFTKDTAQNQMQIQNFGDPFFLVIHEGEALSEIKVRIQKKLQVPDEEFSKWKFAFLSLGRPEYLQDSDIVSSRFQRRDVYGAWEQYLGLEHTDNAPKRSYAVNQNRHTYEKPVKIYN

SEQ ID NO: 4347 - protein, 1116 aa, Populus trichocarpa
MTLMTPPPLNQQEDDEMLVPQTEFADGPQPMEVAQAETATAVDAQSVDDPPSARFTWTIDNFSRLNAKKLYSDVFVVGGYKWRILIFPKGNNVDHLSMYLDVADSATLPYGWSRYAQFSLTVINQLHQKYSIRKDTQHQFNARESDWGFTSFMPLGELYDPGRGYLVNDTCVVEADVAVRKVIDYWSHDSKKETGYVGLKNQGATCYMNSLLQTLYHIPYFRKAVYHMPTTENDIPSGSIPLALQSLFYKLQYSDTSVATKELTKSFGWDTYDSFMQHDVQELNRVLCEKLEDKMKGTVVEGTIQQLFEGHHMNYIECINVDYKSTRKESFYDLQLDVKGCRDVYASFDKYVEVERLEGDNKYHAEQHGLQDARKGVLFIDFPPVLQLQLKRFEYDFMRDTMVKINDRYEFPLQLDLDRENGKYLSPEADRSVRNLYTLHSVLVHSGGVHGGHYYAYIRPTLSDQWFKFDDERVTKEDIKRALEEQYGGEEELPQTNPGFNNSPFKFTKYSNAYMLVYIRESDKEKIICNVDEKDIAEHLRIRLKKEQEEKEQKRKEKAEAHLYTIIKVARSEDLLEQIGKDVYFDLVDHDKVRSFRIQKQITFNLFKEEVAKEFGIPVQLQRFWLWAKRQNHTYRPNRPLTPQEEAQSVGQLREVSNKANNAELKLFLEAEIGQDLRPVPPPEKTKDDILLFFKLYDPSKEELRYVGRLFVKGSGKPLEILTKLNEIAGFAPDQEIELYEEIKFEPNVMCEHIDKRLTFRSSQLEDGDIVCYQKPPPMGSDEQCRYPDVPSFLEYMHNRQVVRFRSLEKSKEDEFCLELSKLHTYDDVAERVAHHLGLDDPSKIRLTSHNCYSQQPKPQPIKFRGVDHLSDMLVHYNQTSDILYYEVLDIPLPELQGLKTLKVAFHHATKDEVVIHTIRLPKQSTVGDVINDLKAKVELSHPSAELRLLEVFYHKIYKIFPHNEKIENINDQYWTLRAEEVPEEEKNLAPHDRLIHVYHFMKDTTQNQVQVQNFGEPFFLVIHEGETLTEVKMRIQKKLQVPDEEFSKWKFAFLSLGRPEYLQDSDIVSSRFQRRDVYGAWEQYLGLEHSDNAPKRSYAANQNRHTFEKPVKIYN

SEQ ID NO: 4348 - protein, 1119 aa, Medicago truncatula
MTVMMSAPIDQQEDEEVLVPHADLPENNNHQPMEVVAQPETANTVESQPVPDPPQTRFTWRIDNFTRLNTKKLYSEVFVVGAYKWRVLIFPKGNNVDYLSMYLDVADSTSLPYGWSRYAQFSLAIVNQIHNKFTVRKDTQHQFNARESDWGFTSFMPLGELYDPSRGYLVNDTLIIEAEVLVRKIVDYWNYDSKKETGYVGLKNQGATCYMNSLLQTLYHIPYFRKAVYHMPTTENDMPSGSIPLALQSLFYKLQYSDTSVATKELTKSFGWDTYDSFMQHDVQELNRVLCEKLEDKMKGTVVEGTIQKLFEGHHMNYIECINVDYKSTRKESFYDLQLDVKGCRDVYASFDKYVEVERLEGDNKYHAEQYGLQDAKKGVLFIDFPPVLQLQLKRFEYDFMRDTMVKINDRYEFPSQLDLDRENGKYLSPDADRSVRNLYTLHSVLVHSGGVHGGHYYAFIRPTLSEQWYKFDDERVTKEDNKRALEEQYGGEEELPQTNPGFNNPPFKFTKYSNAYMLVYIRESDKDKIICNVDEKDIAEHLRERLKKEQEEKEHKKKEKAEAHLYTIIKVARDEDIEGQMGKDIYFDLVDHDKVRSFRVQKQTPFNVFKEEVAKEFGIPVQFQRFWLWAKRQNHTYRPNRPLTQIEETQTVGQLREVSNKVHNAELKLFLEVEKGMDLCPIAPPDKTKDDILLFFKLYDPEKEELRYVGRLFVKCTGKPSEILTRLNEMAGYVPEEDIVLYEEIKFEPNVMCEPIDKKVTFRASQLEDGDIVCFQKAPLVDNEEQVRYPDVPSYLEYVHNRQVVHFRSLDRPKEDDFSLEMSRLYTYDDVVERVAQQLGLDDPSKIRLTPHNCYSQQPKPQPIKHRGVDHLSDMLVHYNQTSDILYYEVLDIPLPELQGLKTLKVAFHHAIKDEVVSHTIRLPKQSTVGDVLDDLKTKVELSHPDAELRLLEVFYHKIYKVFPSNEKIENINDQYWTLRAEEIPEEEKNIGPQDRLIHVYHFTKDTAQNQMQIQNFGDPFFLVIHEGEALSEIKVRIQKKLQVPDEEFSKWKFAFLSLGRPEYLQDSDIVSSRFQRRDVYGAWEQYLGLEHTDNAPKRSYAVNQNRHTFEKPVKIYN

SEQ ID NO: 4349 - protein, 568 aa, Cicer arietinum
MTVMMSAPIDQQEDEEVLVPHADLPDNNHQPMEVVAQPEAANTVESQPVSDPPQSRFTWRIDNFTRLNTKKLYSEVFVVGSYKWRVLIFPKGNNVDYLSMYLDVADSASLPYGWSRYAQFSLAIVNQIHSKYSVRKDTQHQFNARESDWGFTSFMPLGELYDPSRGYLVNDTLIIEAEVLVRKIVDYWNYDSKKETGYVGLKNQGATCYMNSLLQTLYHIPYFRKAVYHMPTTENDMPSGSIPLALQSLFYKLQYSDTSVATKELTKSFGWDTYDSFMQHDVQELNRVLCEKLEDKMKGTVVEGTIQKLFEGHHMNYIECINVDYKSTRKESFYDLQLDVKGCRDVYASFDKYVEVERLEGDNKYHAEQYGLQDAKKGVLFIDFPPVLQLQLKRFEYDFMRDTMVKINDRYEFPLQLDLDRENGKYLSPDADRSVRNLYTLHSVLVHSGGVHGGHYYAFIRPTLSEQWYKFDDERVTKEDNKRALEEQYGGEEELPQTNPGFNNTPFKFTKYSNAYMLVYIRESDKDKIICNVDEKDIAEHLRERLKKEQEEKEHKKKKRPRPIFIQL

SEQ ID NO: 4350 - protein, 1118 aa, Glycine max
MTVMMPAPIDQQEDEEVLVPHADLPANNHQPMEVVAQPENANTVESQPVEDPPSSRFTWRIDNFSRLNTKKLYSEIFVVGAYKWRVLIFPKGNNVDYLSMYLDVADSATLPYGWSRYAQFSLAVVHQTHNKYSVRKDTQHQFNARESDWGFTSFMPLGELYDPSRGYLVNDTLIVEAEVLVRRIVDYWTYDSKKETGYVGLKNQGATCYMNSLLQTLYHIPYFRKAVYHMPTTENDMPTGSIPLALQSLFYKLQYSDTSVATKELTKSFGWDTYDSFMQHDVQELNRVLCEKLEDKMKETVVEGTIQKLFEGHHMNYIECINVDYKSTRKESFYDLQLDVKGCRDVYASFDKYVEVESLEGDNKYHAEQYGLQDAKKGVLFIDFPPVLQLQLKRFEYDFMRDTMVKINDRYEFPLQLDLDREDGKYLSPDADRSVRNLYTLHSVLVHSGGVHGGHYYAFIRPTLSEQWYKFDDERVTKEDNKRALEEQYGGEEELPQTNPGFNNTPFKFTKYSNAYMLVYIRESDKDKIICNVDEKDIAAHLRERLKKEQEEKEHKKKEKAEAHLYTIIKVARDEELKEQIGKDIYFDLVDHDKVRSFRVQKQTSFNLFKEEVAKEYGIPVQFQRYWLWAKRQNHTYRPNRPLTHIEEAQSVGQLREVSNKVHNAELKLFLEVELGMDSRPIAPPDKTKDDILLFFKLYDPEKEELRYVGRLFVKCTGKPLEILTRLNEMAGYDPEEDIALYEEIKFEPNVMCEPIDKKVTFRTSQLEDGDIICFQKASSMDSEENARYPDVPSYLEYVHNRQVVHFRSLDRPKEDDFFLEMSRLFTYDDVVERVAQQLGLDDPSKIRLTPHNCYSQQPKPQPIKYRGVEHLSDMLVHYNQTSDILYYEVLDIPLPELQGLKTLKVAFHHATKEEVVIHTIRLPKQSTVGDVLDDLKTKVELSDPEAELRLLEVFYHKIYKVFPPNEKIESINDQYWTLRAEEIPEEEKNLGSHDRLIHVYHFNKETAQNQMQIQNFGEPFFLVIHEGETLDEIKVRIQKKLQVPDDEFCKWKFAFLSLGRPEYLQDSDVVSSRFQRRDVYGAWEQYLGLEHTDNAPKRSYAVNQNRHTFEKPVKIYN

SEQ ID NO: 4351 - protein, 1045 aa, Triticum aestivum
YSDVFVVGGYKWRVLIFPKGNNVEHLSMYLDVADSANLPYGWSRSAQFSLSVVNQIDQKYTTRKDTQHQFSARESDWGFTSFMPLSELYDPSRGYLVNDTIVVEAEVAVRKMVDYWTYDSKKETGYVGLKNQGATCYMNSLLQTLYHIPYFRKAVYHMPTTENDMPSGSIPLALQSLFYKLQYSDNSVATKELTKSFGWDTYDSFMQHDVQELNRVLCEKLEDKMKGTVVEGTIEQLFEGHHINYIECMNVDYKSNRKESFYDLQLDVKGCRDVYASFDKYVEVERLEGDNKYHAENHGLQDAKKGVLFLDFPPVLQLQLKRFEYDYMRDTMVKINDRYEFPLQLDLDRDDGKYLAPDADRSIRNLYTLHSVLVHSGGVHGGHYYAFIRPTLADQWYKFDDERVTKEDTKKAFEDQYGGEEELPQINPGFNNTPFKFTKYSNAYMLVYIRESDKEKIMCNVDEKDIAEHLRIRLKKEQEEKGHKKKEKAEAHLYTIIKIARDEDLKEQTGKDIYFDLVDHEKVRSFRIQKQLPFSTFKEEVAKEYGIPVQFQRFWLWAKRQNHTYRPNRPLNPHEETQSVGQLREISNKAQNAELKLFLEVEFGLDLQPLPPPEKSKEDILLFFKLYNPEKEVLCFVGRLFVKALGKPSDILRKLTEMAGFTPDEEIELYEEIKFEPNVMCEHIDKKLTFRASQLEDGDIVCFQKSPKADSGTQVRYPDVPSFLEYVHNRQVVHFRSLEKPKDDEFCLELSKLHTYDDVVERVARQLGLDDPAKIRLTSHNCYSQQPKPQPIRYQGVEHLLDMLVHYNQTSDILYYEVLDIPLPELQFLKTLKVAFHHATKEEVVIHSIRLPKNSTIADVIIDLKTKVDLSSPTAELRVLEVFYHKIYKIFPLHEKIENINDQYWTLRAEEVPEEEKNPSQHDRLIHVYHFTKDPLQNQQIQNFGDPFFLAILEGETLAEVKGRIQRKLQVPDEEFSKWKFAFISMNRPDYLQDSDVVSARFQRRDVYGAWEQYLGLEHTDTAPKRAYTANQNRHTHEKPVRIYN

SEQ ID NO: 4352 - protein, 1114 aa, Populus trichocarpa
MTMMTPSPLDQEDEEMLVPHSDLVEGPQPMEVAQVEQTSTVENQPVEDPPSMKFTWTIENFTRLNTKKHYSDIFIVGSYKWRVLIFPKGNNVDHLSMYLDVADSTALPYGWSRYAQFSLAVVNQIHNKYSIRKDTQHQFNARESDWGFTSFMPLSELYDPSRGYLVNDTVVIEAEVAVCKVLDYWSYDSKKETGYVGLKNQGATCYMNSLLQTLYHISYFRKAVYHMPTTENDMPTGSIPLALQSLFFKLQYNDTSVATKELTKSFGWDTYDSFMQHDVQELNRVLCEKLEDKMKGTVVEGTIQQLFEGHHMNYIECINVEYKSTRKESFYDLQLDVKGCRDVYASFDKYVEVERLEGDNKYHAEEHGLQDAKKGVLFIDFPPVLQLQLKRFEYDFMRDTMVKINDRYEFPLQLDLDRENGKYLSPESDRSVRNLYTLHSVLVHSGGVHGGHYYAFIRPTLSDQWFKFDDERVTKEDVKRALEEQYGGEEELPQTNPGFNNTPFKFTKYSNAYMLVYIRESDKDKIICNVDEKDIAEHLRIRLKKEQEEKEDKRRYKAQAHLYTIIKVARDEDLKEQIGKDIYFDLVDHDKVRNFRIQKQTQFSLFKEEVAKELGIPVQFQRFWIWAKRQNHTYRPNRPLTPQEEAQSVGQLREVSNKTHNAELKLFLEVELGLDLRPIAPPEKTKEDILLFVKLYDPEKQELRYVGRLFVKNSSKPIEILAKLNQMAGFASEEEIELYEEIKFEPCVMCEHLDKRASFRTSQIEDGDIICFQKSPPENEEDCRNPDVPSYLEYVHNRQIVHFRSLEKAKEDDFCLELSKLHTYDDVVERVARQIGLDDPSKIRLTSHNCYSQQPKPQPIKYRGVEHLSDMLVHYNQTSDILYYEVLDIPLPELQGLKNLKVAFHHATKDEVVIHNIRLPKQSTVGDVINELKTKVELSHPNAELRLLEVFYHKIYKIFPPNEKIENINDQYWTLRAEEIPEEEKNLGPQDRLIHVYHFTKESGQNQMQVQNFGEPFFLAIHEGETLAEVKMRIQKKLQVPDEEFAKWKFAFLSLGRPEYLQDSDVVFTRFQRRDVYGAWEQYLGLEHSDNTPKRSYAVNQNRHTFEKPVKIYN

SEQ ID NO: 4353 - protein, 1126 aa, Aquilegia formosa
MTMMNPAPLDQQQEDDEMLVPNSDIVEGPQPMEVAAQVEAVSTVENQPVEDPPSSRFTWRIENFTRLNNKKHYSDAFVVGGYKWRVLIFPKGNNVDQLSMYLDVADSSTLPYGWSRYAQFSLSVVNQVYGKYTVRKDTQHQFNARESDWGFTSFMPLSELYDPGRGYLVSDTCIIEAEVAVRKVVDYWTYDSKKETGYVGLKNQGATCYMNSLLQTLYHIPYFRKAVYHMPTTENDMPSGSIPLALQSLFYKLQYSDNSVATKELTKSFGWDTYDSFMQHDVQELNRVLCEKLEDKMKGTVVEGTIQQLFEGHHMNYIECINVDYKSTRKESFYDLQLDVKGCRDVYASFDKYVEVERLEGDNKYHAEQHGLQDAKKGVLFIDFPPVLQLQLKRFEYDFMRDTMVKINDRYEFPLTLDLDRENGKYLSPDADRGVRNLYTLHSVLVHSGGVHGGHYYAFIRPTLSDQWFKFDDERVTKEDLKRALEEQYGGEEELPQTNPGFNNTPFKFTKYSNAYMLVYIRDSDKDKIICNVDEKDIAEHLRMRLKKEQEEKEHKKKEKAEAHLYTIIKVARNEDLVEQIGRDIYFDLVDHDKVRSFRIQKQMSFNVFKEEVAKEFGVPVEFQRFWLWAKRQNHTYRPNRPLTHQEETQSVGQLREVSNKAHNAELKLFLEVELGPESIPISPPEKTKEDILLFFKLYDPKKEELRYVGRLFVKGSGKPIEILPKLNEMAGFSPDEEIDLYEEIKFEPSVMCEPIEKKVTFRSSQLEDGDIVCFQKSLTAESGEEFRHAEVPSFLEYVHNRQVVHFRSLEKPKEDDFCLELSKTFTYDDVVEKVAGHLGLDDPSKIRLTSHNCYSQQPKPQPIKFRGVDHLSDMLVHYNQTSDILYYEVLDIPLPELQTLKTLKVAFHHAAKDEVVIHSIRLPKQSTVGDVIEDLKKKVELSDPEAELRLLEVFYHKIYKIFPPGEKIENINDQYWTLRAEEASIYAPFIPEEEKNLGPHDRLIHVYHFTKDASQNQLQQVQNFGEPFFLVIHEGETLSEVKVRIQKKLQVTDEEFSKWKFAFLSLGRPEYLLDSDIVSSRFQRRDVYGAWEQYLGLEHSDTAPKRAYAANQNRHTYEKPVKIYN

SEQ ID NO: 4354 - protein, 1118 aa, Flaveria ramosissima
MTLMTPPPTMDAEDDEMLVPHSDFAAPEGPQPMEATPAEAPNVVDAPTVVDDPPSARFTWTIENFSRLNSKKMYSDVFFVGGYKWRVLIFPKGNNVDHLSMYLDVADSSTLPYGWSRYAQFSLAVVNQIHNKFTIRKDTQHQFNSRESDWGFTSFMPLSELYDPNKGYLLNDTCIVEADVAVRKIVDYWSHDSKKETGYVGLKNQGATCYMNSLLQTLYHIPYFRKAVYHMPTTENDMPSGSIPLALQSLFYKLQYSDTSVATKELTKSFGWDTYDSFMQHDVQELNRVLCEKLEDKMKGTVVEGTIQQLFEGHHMNYIECINVDYKSTRKESFYDLQLDVKGCRDVYASFDKYVEVERLEGDNKYHAEQHGLQDAKKGVLFIDFPPVLQLQLKRFEYDFMRDTMVKINDRYEFPLQLDLDREDGKYLSPQADRSVRNLYTLHSVLVHSGGVHGGHYYAYIRPTLSDQWFKFDDERVTKEDMKRALDEQYGGEEELPQANPGFNNSPFKFTKYSNAYMLVYIRESDKEKIICNVDEKDIAEHLRIRLKKEQEEKEQKRKEKAEAHLYTIIKVARDEDLREQIGRDIYFDLVDHDKVRSFRIQKQTSFALFKEDVAKEFGVPVQYQRFWLWAKRQNHTYRPNRPLTPQEEAQSVGHLKEVSNKANNAELKLFLEVELGQDLRPISPPEKTKEEILLFFKLYDPLKEELRFVGRLFVKATGKPMEILAKLNEMAGFAPDEEIELFEEIKFEPNVMCEHVDKKLTFRGSQLEDGDIICFQKPLTVENTETCRYPDVPSFLEYVHNRQVVRFRSLEKPKEDEFSLELSKLNNYDDVVERLARHLNLDDPSKIRLTSHNCYSQQPKPQPIKYRGVEHLSDMLAHYNQTSDILYYEVLDIPLPELQGLKTLKVAFHHALKDEVVIHTIRLPKQSTVGDVINDLKTKVELSNPNAELRLLEVFYHKIYKIFPLNEKIENINDQYWTLRAEEIPEEEKNLGPQDRLIHVYHFTKDTTQNQQVQNFGEPFFLVIREGETLAEVKVRIQKKLQVPEEEFSKWKFAFLSLGRPTYLQDSDIVSSRFQRRDVYGAWEQYLGLEHSDNTPKRSYAANQNRHTFEKPVRIYN

SEQ ID NO: 4355 - protein, 997 aa, Trigonella foenum-graecum
MTVMMSAPIDQQEDEEVLVPHADLPENNNHQPMDVVAQPEPANTVESQPVPDPPQTRFTWRIDNFTRLNTKKLYSEVFVVGAYKWRVLIFPKGNNVDYLSMYLDVADSTSLPYGWSRYAQFSLAIVNQIHNKFTVRKDTQHQFNARESDWGFTSFMPLGELYDPSRGYLVNDTLIIEAEVLVRKIVDYWNYDSKKETGYVGLKNQGATCYMNSLLQTLYHIPYFRKAVYHMPTTENDMPSGSIPLALQSLFYKLQYSDTSVATKELTKSFGWDTYDSFMQHDVQELNRVLCEKLEDKMKGTVVEGTIQKLFEGHHMNYIECINVDYKSTRKESFYDLQLDVKGCRDVYASFDKYVEVERLEGDNKYHAEQYGLQDAKKGVLFIDFPPVLQLQLKRFEYDFMRDTMVKINDRYEFPSQLDLDRENGKYLSPDADRSVRNLYTLHSVLVHSGGVHGGHYYAFIRPTLSEQWYKFDDERVTKEDNKRALEEQYGGEEELPQTNPGFNNPPFKFTKYSNAYMLVYIRESDKDKIICNVDEKDIAEHLRERLKKEQEEKEHKKKEKAEAHLYTIIKVARDEDIEGQMGKDIYFDLVDHDKVRSFRVQKQTPFNVFKEEVAKEFGIPVQFQRFWLWAKRQNHTYRPNRPLTHIEETQTVGQLREVSNKVHNAELKLFLEVEKGMDLCPIAPPDKTKDDILLFFKLYDPEKEELRYVGRLFVKCTGKPSEILTRLNEMAGYDPEEDIVLYEEIKFEPNVMCEPIDKKVTFRASQLEDGDIVCFQKAPLVDNEEQVRYPDVPSYLEYVHNRQVVHFRSLDRPKEDDFSLEMSRLYTYDDVVERVAQQLGLDDPSKIRLTPHNCYSQQPKPQPIKHRGVDHLSDMLVHYNQMSDILYYEVLDIPLPELQGLKTLKVAFHHAIKDEVVSHTIRLPKQSTVGDVLDDLKTKVELSHPDAELRLLEVFYHKIYKVFPSNEKIENINDQYWTLRAEEIPEEEKTLVHRIV

SEQ ID NO: 4356 - protein, 1115 aa, Abies balsamea
MTMMAPPPLDQEEDEMLVPHPEFNDGAQPMEVAGQGETVSTVENQPPDDPPSSRFTWAIENFSRLNVKKHYSEIFTVGGYKWRVLTFPKGNNVDHLSMYLDVADSSTLPYGWSRYAQFSLAVVNQISPKYSIRKDTQHQFNARESDWGFTSFMPLGDVYDHSKGYLVNDTLIIEADVVVRRVIDYWSYDSKKETGYVGLKNQGATCYMNSLLQTLYHIPYFRKAVYHMPTTENDMPSSSIPLALQSLFYKLQYSDTSVATKELTKSFGWDTYDSFMQHDVQELNRVLSEKLEDKMKGTVVEGTIQQLFEGHHMNYIECINVDYKSTRKESFYDLQLDVKGCRDVYASFDKYVEVERLEGDNKYHAEQYGLQDAKKGVLFIDFPPVLQLQLKRFEYDFMRDTMVKINDRYEFPLQLDLDRDNGKYLSPDADRSVRNLYTLHSVLVHSGGVHGGHYYAFIRPTLSDQWLKFDDERVTKEDIKRALEEQYGGEEELPQTNPGFNNTPFKFTKYSNAYMLVYIRESDKDKIICNVDEKDIAEHLRVRLKKEQEEKEHKRKEKAEAHLYTIIKVARDEDLAEQIGKDIFFDLVDHDKVRSFRIQKQTPFTVFKEEVAKEFGIPVQFQRFWLWAKRQNHTYRPNRPLSQLEESQSVGHLREASNKANNAELKLFLEVELALDLRPLPLPEKTKDEILLFFKLYDPEKEELRFVGRNFVKAMGKPTEILRSLNEMAGFSPNEEIELFEEIKFEPNVMCEHIDKRLTFRGSQLEDGDIICYQKILSREDEERYRYPDVPSFLEYVHNRQIVHFRCLDKPKEDEFCLELSKLSTYDDVVDRVAQHLGLDDPSKIRLTSHNCYSQQPKPQPIKYRGVDHLSDMLVHYNQSSDILYYEVLDIPLPELQGLKSLKVAFHHSTKDEVSVHSIRLPKQSTVGDVINELRTKVELSNPTAEIRLLEVFYHKIYKIFPLNEKIENINDQYWTLRAEEIPEEEKNLGPHDRLIHVYHFTRDASQNHMVQNFGEPFFLIIREGETLADVKERIQKKLQVPDEEFAKWKFAFLSLGRPEYLQDTDVISSRFQRRDVYGAWEQYLGLEHSDSAPKRSHQTNQNRHTFEKPVKIYN

SEQ ID NO: 4357 - protein, 1115 aa, Eucalyptus grandis
MTVMTPAPIDQQEDEEMLVPHSDLAENNHQPMEAPAEAPNPADNQPVDDPPPSRFTWRIDNFSRLNTKKLYSEIFVVGGYKWRVLVFPKGNNVEYLSMYLDVADSASLPYGWSRYAQFSLGVLNQIHNKYTVRKDTQHQFNARESDWGFTSFMPLSELYDPARGYLMHDTLIVEAEVIVRRVVDYWTYDSKKETGYVGLKNQGATCYMNSLLQTLYHIPYFRKAVYHMPTTENDMPSASIPLALQSLFYKLQYSDSSVATKELTKSFGWDTYDSFMQHDVQELNRVLCEKLEDKMKGTVVEGTIQKLFEGHHMNYIECINVDYKSTRKESFYDLQLDVKGCRDVYASFDKYVEVERLEGDNKYHAEQYGLQDAKKGVLFIDFPPVLQLQLKRFEYDFMRDTMVKINDRYEFPLQLDLDREDGKYLSPDADRSVRNLYTLHSVLVHSGGVHGGHYYAFIRPTLSDQWYKFDDERVTKEDVKRALEEQYGGEEELPPTNPGFNNTPFKFTKYSNAYMLVYIRESDKDKIICDVDEKDIAEHLRERLKKEQEEKEHKKKEKAEAHLYTIIKVARDEDLAEQIGKDIYFDLVDHDKVKSFRIQKQMPFNIFKEEVAKEFGVPVQFQRFWLWAKRQNHTYRPNRPLTPAEEMQSVGQLREVSNKVPNAELKLFLEVELGLDMHPIAPPDKSKEDILLFFKLYDPEKGELRYVGRLFVKGTGKPAEILTKLNEMAGYSPDQEIELYEEIKFEPNVMCEPVDKKVTFRASQLEDGDILCFQKSFPTENGEQFSYPDVPSFLEYVHNRQIVHFRSLEKPKEDDFSLEMSKLYTYDDVVERVAQQLGLDDPSKIRLTSHNCYSQQPKPHPIKYRGVDHLSDMLVHYNQSSDILYYEVLDIPLPELQGLKTLKVAFHHATKDEVVIHTIRLPKQSTVGDVLSDLKTKVELSDPNAELRLLEVFYHKIYKIFPLNEKIENINDQYWTLRAEEIPEEEKNLGQTDRLIHVYHFTKDTAQNQQVQNFGEPFFLVIHEGETLAEIKVRVQKKLQVPDEEFAKWRFAFLSLGRPEYLQDHDIVSNRFQRRDVYGAWEQYLGLEHSDTAPKRAYAANQNRHTFEKPVKIYN

SEQ ID NO: 4358 - protein, 1115 aa, Flaveria ramosissima
MTLLTPPPIDPEEEEMLVPHSEFAGAEGPQPMEVTPAEAPNVVDAPVVDDPPSARFTWTIENFSRLTGKKLYSDVFTVGGYKWRVLIFPKGNNVDHLSMYLDVADSTTLPYGWSRYAQFSLAVVNQIHSKLTMRKDTQHQFNARESDWGFTSFMPLSELYEPTRGYLLNDTCIVEADVAVRKVVDYWSHDSKKETGYVGLKNQGATCYMNSLLQTLYHIPYFRKAVYHMPTTENDMPSGSIPLALQSLFYKLQYSDTSVATKELTKSFGWDTYDSFMQHDVQELNRVLCEKLEDKMKGTVVEGTIQQLFEGHHMNYIECINVDYKSTRKESFYDLQLDVKGCRDVYASFDKYVEVERLEGDNKYHAEQHGLQDAKKGVLFIDFPPVLQLQLKRFEYDFMRDTMVKINDRYEFPLQLDLDRENGKYLSPQADRTVRNLYTLHSVLVHSGGVHGGHYYAYIRPTLSDQWLKFDDERVTKEDMKRAMDEQYGGEEELPQANPGFNNSPFKFTKYSNAYMLVYIRESDKEKIVCNVDEKDVAEHLRIRLKKEQEEKEQKRKEKAEAHLYTIIKVARDENLHEQIGKNIFFDLVDHDKVRSFRIQKQISFALFKEEVAKELGIPVQCQRFWLWAKRQNHTYRPNRPLTPLEEAQSVGHLREVSNKANNAELKLFLEVELGQNSQPVPPPAKTKEEILLFFKLYDPLKEELRYVGRLFVKGTGKPAEILTKLNELAGFAPNEEIELYEEIKFEPTVMCEHVDKKLTFRASQLEDGDIICFQKPLQVGTVKCRYPDVPSFLEYVHNRQVVRFRSLERPKEDEFSLELSKLHNYDDVVERVASHLNLDDPSKIRLTSHNCYSQQPKPQPIKYRGVEHLSDILAHYNQTSDILYYEVLDIPLPELQGLKTLKVAFHHATKDEVVIHTIRLPKQSTVGDVINDLKAKVELSHKDAELRLLEVFYHKIYKIFPLNEKIENINDQYWTLRAEEIPEEEKNLGPQDRLIHVYHFTKDTSQNQQVQNFGEPFFLVIREGETLAEVKIRIQKKLQVPDEEFSKWKFAFLSLGRPTYLQDSDVVSTRFQRRDVYGAWEQYLGLEHSDTTSKRSYAANQNRHTFEKPVRIYN

SEQ ID NO: 4359 - protein, 1100 aa, Vitis vinifera
MLVPHTDFADGPQPMEVAQPDTASAVDAQTVEDPPSARFTWTIENFSRLNTKKLYSDVFYVGGYKWRVLIFPKGNNVDHLSMYLDVADSATLPYGWSRYAQFSLAVINQIHNKFTIRKDTQHQFNARESDWGFTSFMPLGELYDPARGYLVNDTCIVEADVAVRRVIDYWTHDSKKETGYVGLKNQGATCYMNSLLQTLYHIPYFRKAVYHMPTTENDMPSGSIPLALQSLFYKLQYSDTSVATKELTKSFGWDTYDSFMQHDVQELNRVLCEKLEDKMKGTVVEGTIQQLFEGHHMNYIECINVDYKSTRKESFYDLQLDVKGCRDVYASFDKYVEVERLEGDNKYHAEIHGLQDARKGVLFIDFPPVLQLQLKRFEYDFMRDTMVKINDRYEFPLQLDLDRENGKYLSPDADRSVRNLYTLHSVLVHSGGVHGGHYYAYIRPTLSDQWFKFDDERVTKEDIKRALEEQYGGEEELPQTNPGFNNSPFKFTKYSNAYMLVYIRESDKEKIICNVDEKDIAEHLRIRLKKEQEEKEQKRKEKAEAHLYTIIKVARNEDLIEQIGRDIYFDLVDHDKVRSFRIQKQTPFNLFKEEVAKEFGIPVQFQRFWLWAKRQNHTYRPNRPLTLQEEAQSVGQLREVSNKANHAELKLFLEVELGQDLRPVPPPEKTKEEILLFFKLYDPLKEELRYVGRLFVKGSGKPIEILSKLNELAGFSPNEEIELFEEIKFEPNVMCEHIDKRLTFRASQLEDGDIICYQRLLQIDSSQQCRYPDVPSFLEYVHNRQVVRFRSLEKPKEDEFCLELSKLFNYDDVVERVAAHLGLDDSSKIRLTSHNCYSQQPKPQPIKYRGVEHLSDMLLHYNQTSDILYYEVLDIPLPELQGLKTLKVAFHHATKEEVVIHTIRLPKQSTVGDVINDLKSKVELSHPNAELRLLEVFYHKIYKIFPLNEKIENINDQYWTLRAEEIPEEEKNLGPHDRLIHVYHFMKDTTQNQVQVQNFGEPFFLVIHEGETLAEVKVRIQKKLQVPDEEFSKWKFAFLSLGRPEYLQDSDIVSSRFQRRDVYGAWEQYLGLEHSDNAPKRSYAANQNRHTFEKPVKIYN

SEQ ID NO: 4360 - protein, 352 aa, Euphorbia peplus
MTLMTPPPLDQEQDEMLVPHTDFVEGPQPMEVAPAENATAVDAQSVDDPPSARFTWTIDNFSRLNTKKLYSDVFVVGGYKWRILIFPKGNNVDHLSMYLDVADSATLPYGWSRYAQFSLTIANQMHQKYSIRKDTQHQFNARESDWGFTSFMPLGELYDPNRGYLANDTCIVEADVAVRRVIDYWSHDSKKETGYVGLKNQGATCYMNSLLQTLYHIPYFRKAVYHMPTTENDMPSGSIPLALQSLFYKLQYSDTSVATKELTKSFGWDTYDSFMQHDVQELNRVLCEKLEDKMKGTVVEGTIQQLFEGHHMNYIECINVDYKSTRKESFYDLQLDVKGCRDVYALLTNMWR

SEQ ID NO: 4361 - protein, 1115 aa, Helianthus annuus
MTLMTPPPIDAEEDEMLVPHSDFVAPEGPQPMEATPAEAPNVVDAPTVDDPPSARFTWTIENFSRLNSKKLYSDVFFVGGYKWRVLIFPKGNNVDHLSMYLDVADSSTLPYGWSRYAQFSLAVVNQIHNKFTVRKDTQHQFNSRESDWGFTSFMPLSELYDPSKGYLLNDTCIVEADVTVRKVVDYWSHDSKKETGYVGLKNQGATCYMNSLLQTLYHIPYFRKAVYHMPTTENDMPSGSIPLALQSLFYKLQYSDTSVATKELTKSFGWDTYDSFMQHDVQELNRVLCEKLEDKMKGTVVEGTIQQLFEGHHMNYIECINVDYKSTRKESFYDLQLDVKGCRDVYASFDKYVEVERLEGDNKYHAEQHGLQDAKKGVLFIDFPPVLQLQLKRFEYDFMRDTMVKINDRYEFPLQLDLDREDGKYLSPQADRSVRNLYTLHSVLVHSGGVHGGHYYAYIRPTLSDQWFKFDDERVTKEDMKRALDEQYGGEEELPQANPGFNNSPFKFTKYSNAYMLVYIRESDKEKIICNVDEKDIAEHLRIRLKKEQEEKEQKRKEKAEAHLYTIIKVARDEDLHEQIGKDIYFDLVDHDKVRSFRIQKQTPFALFKEDVAKELGIPVQYQRFWLWAKRQNHTYRPNRPLTPQEEAQSVGHLKEVSNKANNAELKLFLEVEVGQDLRPIAPPEKTKDEILLFFKLYDPLKEELRFVGRLFVKATGKPIEILAKLNELAGFTPDEEIELFEEIKFEPNVMCEHVDKKLTFRGSQLEDGDIICFQKPLKVENAETCRYPDVPSFLEYVHNRQVVRFRSLEKPKEDEFSLELSKLNNYDDVVERLARHLNLDDPSKIRLTSHNCYSQQPKPQPIKYRGVEHLSDMLAHYNQTSDILYYEVLDIPLPELQGLKTLKVAFHHATKDEVVIHTIRLPKQSTVGDVINDLKTKVELSNPNAELRLLEVFYHKIYKIFPLNEKIENINDQYWTLRAEEVPEEEKDLGPQDRLIHVYHFTKDTTQNQVQNFGEPFFLVIREGETLAEVKVRIQKKLQVPDEEFSKWKFAFLSLGRPTYLQDSDIVSSRFQRRDVYGAWEQYLGLEHSDNTPKRSYAANQNRHTFEKPVRIYN

SEQ ID NO: 4362 - protein, 909 aa, Fagus grandifolia
MNSLLQTLYHIPYFRKAVYHMPTTENDMPSGSIPLALQSLFYKLQYNDSSVATKELTKSFGWDTYDSFMQHDVQELNRVLCEKLEDKMKGTVVEGTIQQLFEGHHMNYIECINVDYKSTRKESFYDLQLDVKGCRDVYASFDKYVEVERLEGDNKYHAEEHGLQDAKKGVLFIDFPPVLQLQLKRFEYDFMRDTMVKINDRYEFPLQLDLDRENGKYLSPDADRSVRNLYTLHSVLVHSGGVHGGHYYAFIRPTLSDQWFKFDDERVTKEDVKRALEEQYGGEEELPPTNPGFNNTPFKFTKYSNAYMLVYIRESDKDKIICNVDEKDIAEHLRIRLKKEQEEKEDKRRYKAQAHLYTIIKVARDEDLAEQIGRDIYFDLVDHEKVHNFRIQKQTPFNLFKEEVAKEFGIPVQCQRFWIWAKRQNHTYRPNRPLTPQEEVQSVGQLREVSNKTHNAELRLFLEVELGLDLRPIPPPDKTKEEILLFFKLYDPEKGELRYVGRFFVKSSGKPMEIVEKLNQMAGFAPEEEIQLYEEIKFDPCVMCEHLDKRTSFRLSQIEDGDIICFQKSSPLESAEECRYPDVPSFLEYVHNRQVVHFRSLERPKEDDFCLELSKVHSYDEVVERVARRIGLDDPSKIRLTSHNCYSQQPKPQPIKYRGVEHLSDMLVHYNQTSDILYYEVLDIPLPELQGLKNLKVAFHHATKDEVVIHNIRLPKQSTVGDVINVLKTKVELSHPNAEIRLLEVFYHKIYKIFPHNEKIENINDQYWTLRAEEIPEEEKNLGPHDRLIHVYHFTKETAQNQMQVQNFGEPFFLVIHEGETLAEVKGRIQKKLQVPDEEFSKWKFAFLSMGRPEYLQDSDVVSSRFQRRDVYGAWEQYLGLEHSDNTPKRAYAVHQNRHTFEKPVKIYN

SEQ ID NO: 4363 - protein, 1103 aa, Prunus mume
MTVMTPAPIDQPEDEEMLVPHSDLPENNHQPMEVVAQPETANNVENQPVEDPPSSRFTWRIDNFSRMNTKKLYSDIFVVGGYKWRVLIFPKGNNVDHLSMYLDVADSASLPYGWSRYAQFCLGVVNQIHNKYSVRKDTQHQFNARESDWGFTSFMPLSDLYDPSRGYLVHDTLIIEAEVLVRRVVDYWTYDSKKETGYVGLKNQGATCYMNSLLQTLYHIPYFRKAVYHMPTTENDLPSQSIPLALQSLFYKLQYSDNSVATKELTKSFGWDTYDSFMQHDVQELNRVLCEKLEDKMKGTVVEGTIQKLFEGHHMNYIECINVDYKSTRKESFYDLQLDVKGCRDVYASFDKYVEVERLEGDNKYHAEQYGLQDAKKGVLFIDFPPVLQLQLKRFEYDFMRDTMVKINDRYEFPLQLDLDRENGKYLSPEADRSVRNLYTLHSVLVHSGGVHGGHYYAFIRPTLSDQWYKFDDERVTKEDIKRALEEQYGGEEELPQTNPGFNNTPFKFTKYSNAYMLVYIRESDKDKIICNVDEQDIAEHLRGRLKKEQEEKEHKKKEKAEAHLYTIIKVARDENLVEQIGKDIYFDLVDHDKVRSFRIQKQTPFNVFKEEVAKEIGIPVQFLRFWFWAKRQNHTYRPNRPLTPVEETQSVGQLREVSNKVHNAELKLFLEVELGLDLHPIAPPDKTKDDILLFFKLYDPEKEELRYVGRLFVKSTGKAAEILSKLNEMAGYAPEEEIDLYEEIKFEPNVMCEPIDKKFTFRACQLEDGDIVCFQKPTPVENGEHLRYPDVPSFLDYVHNRQVVHFRSLEKPKEDDFSLELSKLHTYDDVVERVAQQLGLDDPSKIRLTSHNCYSQQPKPQPIKYRGVERLTDMLVHYNQTSDILYYEVLDIPLPELQGLKTLKVAFHHATKEEVVIHTIRLPKQSTVGDVINDLKTKVELSHPDAELRLLEVFYHKIYKVFPHSEKIENINDQYWTLRAEEVPDEEKNLGPNDRVIHVYHFTKDTAQNQMQIQNFGEPFFLVIHEGETLAEIKARVQKKLQVADEEFAKDSDIVSSRFQRRDVYGAWEQYLGLEHSDSAPKRAYAANQNRHTFEKPVKIYN

SEQ ID NO: 4364 - protein, 1101 aa, Malus domestica
MLVPHSDLPENNHQPMEVVAQPETANNVENQPVEDPPSSRFTWRIDNFTRMNTKKHYSDVFVVGSYKWRVLIFPKGNNVDHLSMYLDVADSSSLPYGWSRYAQFSLGVINQIHNKYSVRKDTQHQFNARESDWGFTSFMPLSELYDPSRGYLVNDTIIVEAEVLVRRVVDYWTYDSKKETGYVGLKNQGATCYMNSLLQTLYHIPYFRKAVYHMPTTENDLPSQSIPLALQSLFYKLQYSDNSVATKELTKSFGWDTYDSFMQHDVQELNRVLCEKLEDKMKGTVVEGTIQKLFEGHHMNYIECINVDYKSTRKESFYDLQLDVKGCRDVYASFDKYVEVERLEGDNKYHAEHYGLQDAKKGVLFIDFPPVLQLQLKRFEYDFMRDTMVKINDRYEFPLQLDLDRENGKYLSPEADRSVRNLYTLHSVLVHSGGVHGGHYYAFIRPTLTDLWYKFDDERVTKEDIKRALEEQYGGEEELPQTNPGFNNTPFKFTKYSNAYMLVYIRESDRDKIICNVDEKDIAEHLRERLKKEQEEKEHKKKEKAEAHLYTIIKVARDENLMEQIGKDIYFDLVDHDKVRSFRIQKQTPFNIFKEEVAKEFGIPVQFQRFWLWAKRQNHTYRPNRPLTPMEETQSVGQLREVSNKVHNAELKLFLEVELGPDLHHIAPPDKTKDDILLFFKLYDPEKEELRYVGRLFVKSTGKAAEILSKLNEMAGYAPEEEIDLYEEIKFEPTVMCEPIDKKFTFRACQLEDGDIVCFQKPTSVEIEHLRYPDVPSFLEYVHNRQVVHFRSLEKPKEDDFSLELSKLHTYDDVVERVAQQLGLDDPSKLRLTPHNCYSQQPKPQPIKYRGVDHLTDMLVHYNQTSDILYYEVLDIPLPELQGLKTLKVAFHLATKEEVVIHTIRLPKQSTVGDVINDLKTKVELSHPDAELRLLEVFYHKIYKVFPHSEKIENINDQYWTLRAEEVPEEEKNLGPNDRVIHVYHFTKDTAQNQMQIQNFGEPFFLVIHEGETLAEVKARVQKKLQVADEEFAKWKFAFLSLGRPEYLQDSDIVSSRFQRRDVYGAWEQYLGLEHSDSAPKRSYAANQNRHMFEKPVKIYN

SEQ ID NO: 4365 - protein, 1114 aa, Manihot esculenta
MTLMTPPPLDQEDEEMLVPHSDLVEGPQPMEVAQVDSASTVDNQAVEDPPSMKFTWTIENFSRLNTKKHYSDTFLVGSYKWRILIFPKGNNVDHLSMYLDVADSATLPYGWSRYAQFSLAVVNQIHNKYSIRKDTQHQFNVRESDWGFTSFMPLSDLYDPSRGYLVNDTVIVEAEVAVRKILDYWSYDSKKETGYVGLKNQGATCYMNSLLQTLYHIPYFRKAVYHMPTTENDMPTGSIPLALQSLFYKLQYNDTSVATKELTKSFGWDTYDSFMQHDVQELNRVLCEKLEDKMKGTVVEGTIQQLFEGHHMNYIECINVDYKSTRKESYYDLQLDVKGCRDVYASFDKYVEVERLEGDNKYHAEEHGLQDAKKGVLFIDFPPVLQLQLKRFEYDFMRDTMVKINDRYEFPLQLDLDRENGKYLSPEADRSVRNLYTLHSVLVHSGGVHGGHYYAFIRPTLSDQWFKFDDERVTKEDMKRALEEQYGGEEELPQTNPGFNNAPFKFTKYSNAYMLVYIRESDKDNIICNVDEKDIAEHLRVRLKKEQEEKEDKRRYKAQAHLYTIIKVARDEDLKEQIGRDIYFDLVDHDKVRNFRIQKQTSFSHFKEEVAKEFGVPVQLQRFWIWAKRQNHTYRPNRPLTAHEEAQSVGQLREVSNKAHNAELKLFLEVEFGLDLRPIAPPEKTKEDILLFFKLYDPAKGELRYVGRLFVKGSGKPMEILAKLKQMAVIASDEEIELYEEIKFEPCVMCEHLDKRTSFRLSQLEDGDIICFQKTPLAGEEDCRYPDVPSFLEYVHNRQIVHFRSLEKPKEDDFCLELSKLHTYDDVVERVARQIGLDDPSKIRLTSHNCYSQQPKPQPIKYRGVEHLSDMLVHYNQTSDILYYEVLDIPLPELQGLKNLKVAFHHATKDEVVIHNIRLPKQSTVGDVINELRTKVELSHPNAELRLLEVFYHKIYKIFPHNEKIENINDQYWTLRAEEIPEEEKSLGPHDRLIHVYHFTKETAQNQMQVQNFGEPFFLVIHEGETLAEVKSRIQKKLQVPDEEFAKWKFAFLSLGRPEYLQDSDIVFTRFQRRDVYGAWEQYLGLEHSDNTPKRSYAVNQNRHTFEKPVKIYN

SEQ ID NO: 4366 - protein, 1116 aa, Citrus clementina
MTMMTPPPLDQEEEEMLVPHSDIVEGPQPMEVVSQVEPASTVENQQVEDPPTMKFTWTIENFSRLNTKKHYSDVFVVGGYKWRILIFPKGNNVDHLSMYLDVADSGTLPYGWSRYAQFSLAVVNQIHSKYSIRKDTQHQFNARESDWGFTSFMPLGDLYDPSRGYLVNDSVVVEAEVAVRKVLDYWSYDSKKETGYVGLKNQGATCYMNSLLQTLYHIPYFRKAVYHMPTTENDLPSGSIPLALQSLFYKLQYNDTSVATKELTKSFGWDTYDSFMQHDVQELNRVLCEKLEDKMKGTVVEGTIQQLFEGHHMNYIECINVDYKSTRKESFYDLQLDVKGCRDVYASFDKYVEVERLEGDNKYHAEEHGLQDAKKGVLFIDFPPVLQLQLKRFEYDFMRDAMVKINDRYEFPLQLDLDRENGKYLSPDADRSVRNLYTLHSVLVHSGGVHGGHYYAFIRPTLSDQWYKFDDERVTKEDVKRALEEQYGGEEELPPTNPGFNNTPFKFTKYSNAYMLVYIRESDKDKIICNVDEKDIAEHLRIRLKKEQEEKEDKRRYKAQAHLYTIIKVARDEDLAEQIGRDIYFDLVDHDKVRSFRVQKQTSFMAFKEEIAKEFGIPIQLQRFWIWAKRQNHTYRPNRPLLPQEEAQTVGQLREVSNKTHTAELRLFLEVEFGPDLHPIAPPDKSKDDILLFFKLYDPEKGELRYVGRLFLKSSSKPIEILRKLNQMAGFDPDEEIELYEEIKFEPCVMCEHLDKRTSFRLSQIEDGDIICFQKSPPLESEQECRYPDVPSFLEYVHNRQIVRFRALDRPKEDAFCLELSKQHSYDEVVERVARKIGLDDPSKIRLTPHNCYSQQPKPQPIKYRGVEHLSDMLVHYNQTSDILYYEVLDIPLPELQGLKNLKVAFHHATKDEVVIHNIRLPKQSTVGDVINELKTKVELSHPNAELRLLEVFYHKIYKIFAPNEKIENINDQYWTLRAEEIPEEEKNLGPNDRLIHVYHFTKESAQNQMQVQNFGEPFFLVIHEGETLAEVKERIQRKLQVPDEEFSKWKFAFLSLGRPEYLVDTDTVFNRFQRRDVYGAWEQYLGLEHSDNAPKRAYSVNQNRHTYEKPVKIYN

SEQ ID NO: 4367 - protein, 1113 aa, Pinus taeda
MTMMAPPPLDQEEDEMLVPHPEFNDGAQPMEGQGETVSTAENQPPDDPPSSRFTWAVDNFSRLNLKKHYSEVFTVGGYKWRVLIFPKGNNVDHLSMYLDVADSATLPYGWSRYAQFSLAVVNQISPKYSIRKDTQHQFNARESDWGFTSFMPLGDVYDHSKGYLVNDTLIIEADVVVRRVIDYWSYDSKKETGYVGLKNQGATCYMNSLLQTLYHIPYFRKAVYHMPTTENDMPSSSIPLALQSLFYKLQYSDTSVATKELTKSFGWDTYDSFMQHDVQELNRVLSEKLEDKMKGTVVEGTIQQLFEGHHMNYIECINVDYKSTRKESFYDLQLDVKGCRDVYASFDKYVEVERLEGDNKYHAEQYGLQDAKKGVLFIDFPPVLQLQLKRFEYDFMRDTMVKINDRYEFPLQLDLDRDDGKYLSPDADRSVRNLYTLHSVLVHSGGVHGGHYYAFIRPTLSDQWFKFDDERVTKEDIKRALEEQYGGEEELPQTNPGFNNTPFKFTKYSNAYMLVYIRESDKDKIICNVDEKDIAEHLRVRLKKEQEEKEHKRKEKAEAHLYTIIKVARDEDLAEQIGKDIFFDLVDHDKVRSFRIQKQTPFTVFKEEVAKEFGIPIQFQRFWLWAKRQNHTYRPNRPLSQLEESQSVGHLREASNKANNAELKLFLEVELTVDLRPLPLPEKTKDEILLFFKLYDPEKEELRFVGRSFVKAVGKPTEILRSLNEMAGFSPNEEIELFEEIKFEPNVMCEHVDKRLTFRGSQLEDGDIICYQKVLSREEEERYRYPDVPSFLEYVHNRQIVHFRCLDKPKEDEFCLELSKLSTYDDVVERVAQQLGLDDPSKIRLTSHNCYSQQPKPQAIKYRGVDHLSDMLVHYNQSSDILYYEVLDIPLPELQGLKSLKVAFHHSTKDEVSIHSIRLPKQSTVGDVINELRTKVELSHPTAEIRLLEVFYHKIYKIFPPTEKIENINDQYWTLRAEEIPEEEKNLGPHDRLIHVYHFTRDALQNHMVQNFGEPFFLVIREGETLSDVKERIQKKLQVPDEEFSKWKFAFLSLGRPEYLQDTDVISSRFQRRDVYGAWEQYLGLEHSDSAPKRSHQTNQNRHTFEKPVKIYN

SEQ ID NO: 4368 - protein, 1118 aa, Citrus clementina
MTIMTPAPIDQQEDEEMLVPHSDLADNHQPMEVVAQPETANAVENNQPLDDPPSSRFTWRIENFSRLNTKKHYSEIFIVGGFKWRVLIFPKGNNVDHLSMYLDVADSSSLPYGWSRYAQFSLAVINQIHSKYSVRKDTQHQFNARESDWGFTSFMPLGELYDPNRGYLVNDTLIVEAEVIVRRVVDYWSYDSKKETGYVGLKNQGATCYMNSLLQTLFHIPYFRKAVYHMPTTENDMPSGSIPLALQSLFYKLQYSDSSVATKELTKSFGWDTYDSFMQHDVQELNRVLSEKLEDKMKGTVVEGTIQQLFEGHHMNYIECINVDYKSTRKESFYDLQLDVKGCRDVYASFDKYVEVERLEGDNKYHAEQYGLQDAKKGVLFIDFPPVLQLQLKRFEYDFMRDTMVKINDRYEFPLQLDLDRENGKYLSPDADRSVRNLYTLHSVLVHSGGVHGGHYYAFIRPTLSDQWYKFDDERVTKEDLKRALEEQYGGEEELPQTNPGFNNTPFKFTKYSNAYMLVYIRESDKDKIICNVDEQDIAEHLRERLKKEQEEKEHKKKEKAEAHLYTVIKVARDDDLLEQIGKDIYFDLVDHDKVRSFRIQKQIPFNLFKEEVAKEFGVPVQLQRFWLWAKRQNHTYRPNRPLTHLEETQTVGQLREVSNKVHNAELKLFLEVERGPDLRPIAPPEKTKEDILLFFKLYDPEKEELRYVGRLFVKSTGKPMEYLPKLNEMAGYAPDEEIDLYEEIKFEPSVMCEPIEKRCTFRASQLEDGDIICFQKSTPIEGVGKFRYPEVPSFLDYVHNRQVVHFRSLEKPKEDDFCLEMSKLYTYDDVVERVAQQLGLDDPSKIRLTSHNCYFQQLNPHPLSTVGLIIYLTCVIHYNQTSDVLYYEVLDIPLPELQCLKTLKVAFHHATKDEVSVHTIRLPKQSTVGDVINDLKTKVELSHPDAELRLLEVFYHKIYKIFPLNEKIENINDQYWTLRAEEIPEEEKNLGPHDRLIHVYHFTKETAQNQMQIQNFGEPFFLVIHEGETLQEIKVRIQRKLQVPDEEFAKWKFAFLSLGRPEYLQDTDIVSSRFQRRDVYGAWEQYLGLEHSDSAPKRAYAANQNRHTYEKPVKIYN

SEQ ID NO: 4369 - protein, 1102 aa, Cucumis sativus
MLVPHSDLAENNHQPMEVVPQSETGNTVENQPVEDPPSSRFTWRIDNFTRLNIKKLYSEIFIVGGYKWRILIFPKGNNVDHLSMYLDVADSASLPYGWSRYAQFSLGVINQIHNKYSVRKDTQHQFNARESDWGFTSFMPLSELYDPTRGYLVNDTLIVEAEVLVRRVVDYWTYDSKKETGFVGLKNQGATCYMNSLLQTLYHIPYFRKAVYHMPTTENDMPSASIPLALQSLFYKLQYSDSSVATKELTKSFGWDTYDSFMQHDVQELNRVLSEKLEDKMKGTVVEGTIQKLFEGHHMNYIECINVDYKSTRKESFYDLQLDVKGCRDVYASFDKYVEVERLEGDNKYHAEQYGLQDAKKGVLFIDFPPVLQLQLKRFEYDFMRDTMVKINDRYEFPLQLDLDRENGKYLSPEADKTVRNLYTLHSVLVHSGGVHGGHYYAFIRPTLSEQWYKFDDERVTKEDVKRALEEQYGGEEELPQTNPGFNNTPFKFTKYSNAYMLVYIRESDKDKVICNVDEKDIAEHLRERLKKEQEEKEHKKKEKAEAHLYTIIKVARDEDLVEQIGKDIFFDLVDHDKVRSFRIQKQMPFNLFKEEVAKEFGIPIQFQRYWLWAKRQNHTYRPNRPLTPMEEAQSVGQLREVSNKVHNAELKLLLEVEYGPDSRPIAPPDKTKDDILLFFKLYEPEKEELRYVGRLFVKGNGKPFEILTKLNEMAGYAPEEEIELYEEIKFEPNIMCEPIDKKFTFRASQLEDGDIVCFQKSPPVENTEQYRYPDVPSFLEYVHNRQVVHFRSLEKPKEDDFCLEMSKLYTYDEVVERLAQQLGVDDPSKIRLTSHNCYSQQPKPQPIKYRGVEHLSDMLVHYNQTSDILYYEVLDIPLPELQGLKTLKVAFHHATKDEVVIHTIRLPKQSTVADVINDLKTKVELSHPDAELRLLEVFYHKIYKVFPPNEKIENINDQYWTLRAEEIPEEEKNLGPNDRLIHVYHFTKDTAQNQMQIQNFGEPFFLVINEGETLADIKLRIQKKLQVPDEEFAKWKFAFLSLGRPEYLQDTDIVSNRFQRRDVYGAWEQYLGLEHTDNAPKRAYTANQNRHTFEKPVKIYN

SEQ ID NO: 4370 - protein, 1116 aa, Citrus sinensis
MTMMTPPPLDQEEEEMLVPHSDIVEGPQPMEVVSQVEPASTVENQQVEDPPTMKFTWTIENFSRLNTKKHYSDVFVVGGYKWRILIFPKGNNVDHLSMYLDVADSGTLPYGWSRYAQFSLAVVNQIHSKYSIRKDTQHQFNARESDWGFTSFMPLGDLYDPSRGYLVNDSVVVEAEVAVRKVLDYWSYDSKKETGYVGLKNQGATCYMNSLLQTLYHIPYFRKAVYHMPTTENDLPSGSIPLALQSLFYKLQYNDTSVATKELTKSFGWDTYDSFMQHDVQELNRVLCEKLEDKMKGTVVEGTIQQLFEGHHMNYIECINVDYKSTRKESFYDLQLDVKGCRDVYASFDKYVEVERLEGDNKYHAEEHGLQDAKKGVLFIDFPPVLQLQLKRFEYDFMRDAMVKINDRYEFPLQLDLDRENGKYLSPDADRSVRNLYTLHSVLVHSGGVHGGHYYAFIRPTLSDQWYKFDDERVTKEDVKRALEEQYGGEEELPPTNPGFNNTPFKFTKYSNAYMLVYIRESDKDKIICNVDEKDIAEHLRIRLKKEQEEKEDKRRYKAQAHLYTIIKVARDEDLAEQIGRDIYFDLVDHDKVRSFRVQKQTSFMAFKEEIAKEFGIPIQLQRFWIWAKRQNHTYRPNRPLLPQEEAQTVGQLREVSNKTHTAELRLFLEVEFGPDLHPIAPPDKSKDDILLFFKLYDPEKGELRYVGRLFLKSSSKPIEILRKLNQMAGFDPDEEIELYEEIKFEPCVMCEHLDKRTSFRLSQIEDGDIICFQKSPPLESEQECRYPDVPSFLEYVHNRQIVRFRALDRPKEDAFCLELSKQHSYDEVVERVARKIGLDDPSKIRLTPHNCYSQQPKPQPIKYRGVEHLSDMLVHYNQTSDILYYEVLDIPLPELQGLKNLKVAFHHATKDEVVIHNIRLPKQSTVGDVINELKTKVELSHPNAELRLLEVFYHKIYKIFAPNEKIENINDQYWTLRAEEIPEEEKNLGPNDRLIHVYHFTKESAQNQMQVQNFGEPFFLVIHEGETLAEVKERIQRKLQVLDEEFSKWKFAFLSLGRPEYLVDTDTVFNRFQRRDVYGAWEQYLGLEHSDNAPKRAYSVNQNRHTYEKPVKIYN

SEQ ID NO: 4371 - protein, 1116 aa, Aquilegia formosa
MTVMTPPPPIDQEDEDMLVPHSDLVEGPQPMEAQADTAVSTVENQPVEDPASSRFTWQIENFSRLNTKKHYSEVFIVGGYKWRVLIFPKGNNVDHLSMYLDVADSANLPYGWSRFAQFSLAVVNQGSNRYTVRKDTQHQFNVRESDWGFTSFMPLSELYDISKGFLHNDTLVIEAEVAVRKVVDYWSYDSKKETGYVGLKNQGATCYMNSLLQTLYHIPYFRKAVYHMPTTENDMPSGSIPLALQSLFYKLQYSDNSVATKELTKSFGWDTYDSFMQHDVQELNRVLCEKLEVKMKGTVVEGTIQQLFEGHHMNYIECINVDYKSTRKESFYDLQLDVKGCRDVYASFDKYVEVERLEGDNKYHAEQHGLQDAKKGVLFIDFPPVLQLQLKRFEYDFMRDTMVKINDRYEFPLQLDLDRENRKYLSPDADSRVRNLYTLHSVLVHSGGVHGGHYYAFIRPTLSDQWLKFDDERVTKEDMKRALEEQYGGEEELPQTNPGFNNTPFKFTKYSNAYMLVYIRDSDKDKIICNVDEQDIAEHLRVRLKKEQEEKEHKKKEKAEAHLYTIIKVARNEDLAEQIGRDIYFDLVDHDKVRSFRIQKQTAFNVFKEEVAKEFGIPVQYQRFWLWAKRQNHTYRPNRPLTPQEETQSVGMLREVSNKAHNAELKLFLEVELGQDLLPIEPPEKTKEDILLFFKLYDPVKEELRYIGRIFVKGSGKPSEILTKLNEMAGFPSNQEIELYEEIKFEPSVMCEHIDKKVSFRSSQLEDGDIVCFQKSPPVESGQQCRYPDVPSFLEYVHNRQVVHFRSLEKPKEDDFCLELSKLFNYDEVVERVARQLGLDDPSKIRLTPHNCYSQQPKPAPIKYRGMEHLSEMLVHYNQTSDILYYEVLDISLPELQWLKTLKVAYHHATKEDVVIHSIRLPKHSTVGDVLLHLKSKVELSHPDAELRLLEVFYHKIYKIFPTSEKIENINDQYWTLRAEEIPEEEKNLGLNDRLIHVYHFTKDTSQNQMQVQNFGEPFFFIIHEGETLAEVKGRIQKKLQVSDEEFSKWKFAFLSLGRPEYLLDSDIVSSRFQRRDVYGAWEQYLGLEHSDSAPKRAYAANQNRHTFEKPVKIYN

SEQ ID NO: 4372 - protein, 1151 aa, Musa acuminata
MTMMTPPPLDVPLIFVPLFLQQEDEEMLVPHQEFPEGPQPMEVIPNEMGTAPESQQVEDPPSFKFRWTIENFSRLNIKKLYSDIFYVGGYKWRVLIFPKGNNVDHLSIYLDVADSATLPYGWSRYAQFALAVVNQIHSKYTIRKDTQHQFNSRESDWGFTSFMSLSELYDPSRGYLVNDTCVIEAEVVVRRVVDYWSYDSKKETGFVGLKNQGATCYMNSLLQTLYHIPYFRKAVYHMPTTENDMPSGSIPLALQSLFYKLQYSDNSVATKELTKSFGWDTYDSFMQHDVQELNRVLCEKLEDKMKGTVVEGTIQHLFEGHHMNYIECINVDYKSTRKESFYDLQLDVKGCRDVYASFDKYVEVERLEGDNKYHAENHGLQDAKKGVLFIDFPPVLQLQLKRFEYDFMRDTMVKINDRYEFPLQLDLDSDNGKYLSPEADRRVRNLYTLHSVLVHSGGVHGGHYYAFIRPTLSDQWFKFDDERVTKEDAKRALEEQYGGEEELPQTNPGFNNTPFKFTKYSNAYMLVYIRESDKEKIMCDVDEKDIAEHLRIRLKKEQEEKENKKKEKAEAHLYTIIKVARNEDLAEQIGKEIFFDLVDHDKVRNFRVQKQLPFSHFKEEVAKEFGIPVQFHRFWLWAKRQNHTYRPNRPLTPQEEAQPVGQLREVSNKAHNAELKLFLEVELGPDLCPVPPPSKTKEEILLFFKLYDPEKEELRFVGRLFLKSLGKPIEVLTKLNEMAGFPPNEEIELYEVGFSFEVLILFLANLYITRKKKVSQEIKFEPNVMCEHIDKRISFRSSQIEDGDIICYQRASALGNEDQYRYPDVPSFLEYVHNRQVVHFRSLEKPKEDDFSLELSKMFTYDDVVERVAHQLGVDDPSKIRLTSHNCYSQQPKPQPIKYRGVDHLSDMLVHYNQTSDILYYEVLDIPLPELQGLKTLKVAFHHATKDEVAVHSIRLPKNSTVADVINDLRTKVELSHPDAELRLLEVFYHKIYKIFPPGEKIENINDQYWTLRAEEIPEEEKNLSPHDRLIHVYHFTKDPNQNQTQVQNFGEPFFMVIREGETLADVKIRIQKKLQVPEEDFSKWQLAFVALGRPEYLQDSDIVSNRFQRRDIYGAWEQYLGLEHSDTAPKRAYTANQNRHTFEKPVKIYN

SEQ ID NO: 4373 - protein, 1120 aa, Ricinus communis
MTMMTPPPLDQEDEEMLVPHSDLVEGPQPMEVAQVEPASTVENQPVEDPPSMKFTWTIENFSRLNTKKHYSDVFVVGGYKWRILIFPKGNNVDHLSMYLDVSDSSTLPYGWSRYAQFSLAVVNQIHNKYSIRKDTQHQFNARESDWGFTSFMPLSDLYDPSRGYLVNDTVIVEAEVAVRKVLDYWSYDSKKETGYVGLKNQGATCYMNSLLQTLYHIPYFRKAVYHMPTTENDMPTGSIPLALQSLFYKLQYNDTSVATKELTKSFGWDTYDSFMQHDVQELNRVLCEKLEDKMKGTVVEGTIQQLFEGHHMNYIECINVDYKSTRKESFYDLQLDVKGCRDVYASFDKYVEVERLEGDNKYHAEEHGLQDAKKGVLFIDFPPVLQLQLKRFEYDFMRDTMVKINDRYEFPLQLDLDRENGKYLSPEADRSVRNLYTLHSVLVHSGGVHGGHYYAFIRPTLSDQWFKFDDERVTKEDMKRALEEQYGGEEELQQTNPGFNNAPFKFTKYSNAYMLVYIRESDKDKIICNVDEKDIAEHLRIRLKKEQEEKEDKRRYKAQAHLYTIIKVARDEDLKEQIGRDIYFDLVDHDKVRNFRIQKQTPFNFFKEEVAKEFGIPVQFQRFWIWAKRQNHTYRPNRPLTPQEEAQSVGQLREASNKAHSAELKLFLEVELGLDLRPIAPPDKTKEDILLFFKLYVPEKGELRYIGRLFVKSSGKPIEILAKLNEMAGFATDEEIELYEEIKFEPCVMCEHLDKRTSFRLSQIEDGDIICFQKSPPLEVEEDCKYPDVPSFLEYVHNRQVVHFRSLEKPKEDDFCLELSKLHTYDDVVEKVAQQIGLDDPSKIRLTSHNCYSQQPKPQPIKYRGVEHLSDMLVHYNQTSDILYYEVLDIPLPELQGLKNLKVAFHHATKDEVVIHNIRLPKQSTVGDVINELKAKVELSHPNAELRLLEVFYHKIYKIFPPNEKIENINDQYWTLRAEEVPEEEKNLGPHDRLIHVYHFAKETAQNQLQVQNFGEPFFLVIHEGETLSDVKVRIQNKLQVPDEEFAKWKFAFLSLGRPEYLQDSDIVFTRFQRRDVYGAWEQYLGLEHSDNTPKRSYAVNQGRADDPPPARYVEFGTTP

SEQ ID NO: 4374 - protein, 1115 aa, Fragaria vesca
MTMMTPPPVDQEDEEMLVPSTDVVVEGPQPMEVAQVEPASTVDNQPVEEPPTMKFTWTIENFSRLNTKKHYSDMFIVGGYKWRILIFPKGNNVDYLSMYLDVADSQALPYGWSRYAQFSLAIVNQIHNKYSIRKDTQHQFNARESDWGFTSFMPLGDLYDPGRGYLVNDTVVVEAEVVVRKVLDYWSYDSKKETGYVGLKNQGATCYMNSLLQTLYHIPYFRKAVYHMPTTENDMPSGSIPLALQSLFYKLQYNESSVATKELTKSFGWDTYDSFMQHDVQELNRVLCEKLEDKMKGTVVEGTIQQLFEGHHMNYIECINVDYKSTRKESFYDLQLDVKGCRDVYASFDKYVEVERLEGDNKYHAEEHGLQDAKKGVLFIDFPPVLQLQLKRFEYDFMRDTMVKINDRYEFPLQLDLDRENGKYLSPESDKSVRNLYTLHSVLVHSGGVHGGHYYAFIRPTLTDQWYKFDDERVTKEDVKRALEEQYGGEEEMPQTNPGFNNTPFKFTKYSNAYMLVYIRDSDKDKIICDVDEKDIAEHLRVRLKKEQEEKEDKRRYKAQAHLYTIIKVARDEDLAEQIGRDIYFDLVDHDKVRSFRIQKQTPFNLFKEEVAKELGIPVQFQRFWIWAKRQNHTYRPNRPLTPQEELQTVGQLREASNKTHNAELKLFLEVELGPEQVPIPPPDKTKDDILLFFKLYEPEKRELRFVGRLFVKSSTKPIEIIAKINQMAGFAPDEEIELYEEIKFEPCIMCEHLDKRTSFRLSQIEDGDIICFQKPTPLESEECKYPDVPSFLEYVHNRQIVHFRSLEKPKEDDFSLELSKLHTYDDVVEKVASQIGLDDPTKIRLTAHNCYSQQPKPQPIKYRGVEHLTDMLVHYNQSSDILYYEVLDIPLPELQGLKNLKVAFHHATKDEVVIHNIRLPKQSTVGDVINVLKTKVELSQPNAELRLLEVFYHKIYKIFPHSEKIENINDQYWTLRAEEIPEEEKNLGANDRLIHVYHFTKETAQNQMQVQNFGEPFFLVIHEGETLAEVKARIQKKLQVPDEEFAKWKFAFLSLGRPEYLQDTDVVSSRFQRRDVYGAWEQYLGLEHADTAPKRSYAVNQNRHTYEKPVKIYN

SEQ ID NO: 4375 - protein, 1101 aa, Valeriana officinalis
MLVPNQELVAEGPQPMEVAPAEAASTVDAPAVEDPPSARFTWTIENFSRLNTKKLYSDVFYVGGYKWRVLIFPKGNNVDHLSMYLDVADSSNLPYGWSRYAQFSLAVVNQIHNKFVVRKETQHQFNARESDWGFTSFMPLSELYDPGRGYLVNDTCIVEADVAVRKVVDYWSHDSKKETGFVGLKNQGATCYMNSLLQTLYHIPYFRKAVYHMPTTENDMPSGSIPLALQSLFYKLQYSDTSVATKELTKSFGWDTYDSFMQHDVQELNRVLCEKLEDKMKGTVVEGTIQQLFEGHHMNYIECINVDYKSTRKESFYDLQLDVKGCRDVYASFDKYVEVERLEGDNRYHAEQHGLQDAKKGVLFIDFPPVLQLQLKRFEYDFMRDTMVKINDRYEFPLQLDLDRENGKYLSPDADRRVRNLYTLHSVLVHSGGVHGGHYYAYIRPVLSDQWFKFDDERVTKEDMKRALEEQYGGEEELPQTNPGFNNSPFKFTKYSNAYMLVYIRESDKDKIICNVDEKDIAEHLRIRLKKEQEEKEQKRKEKAEAHLYTIIKVARDEDLVEQIGRDIYFDLVDHDKVRSFRIQKQISFNLFKEEVAKELGIPVQFQRFWLWAKRQNHTYRPNRPLTPQEEAQSVGQLREVSNKANNAELKLFLEVELGQDLKPIPPPEKIKEDILLFFKLYDPVKEELRYVGRLFVKGSSKPAEILTKLNELVGFAPDQEIELFEEIKFEPSVMCEHIDKKLTFRGSQLEDGDIICFQKPVSAENTEQYRYPDVPSFLEYVHNRQVVRFRSLEKPKEDEFCLELSKLHNYDDVVERVARHLNLDDPSKIRLTPHNCYSQQPKPTPIKYRGAEHLSDMLVHYNQTSDILYYEVLDIPLPELQGLKTLKVAFHHATKDEVVIHTIRLPKQSTVGDVISDLKTKVELSQPNAELRLLEVFYHKIYKIFPLNEKIENINDQYWTLRAEEIPEEEKNLGSHDRLIHVYHFMKDSAQNQVQVQNFGEPFFLVIHESETLADVKVRIQKKLQVPDEDFAKWKFAFLALGRPEYLQDTDIVSSRFQRRDVYGAWEQYLGLEHSDNTPKRSYAASQNRHTFEKPVRIYN

SEQ ID NO: 4376 - protein, 480 aa, Ambrosia trifida
MTLLTPPPIDAEDDEMLVPHSDFAPPEGPQPMEATPAEAPNVVDAPTVVDDPPSARFTWTIENFSRLNSKKLYSDVFFVGGYKWRVLIFPKGNNVDHLSMYLDVADSSTLPYGWSRYAQFSLAVVNQIHNKFTVRKDTQHQFNSRESDWGFTSFMPLSELYDPSKGYLMNDTCIVEADVAVRKVVDYWSHDSKKETGYVGLKNQGATCYMNSLLQTLYHTPYFRKAVYHMPTTENDMPSGSIPLALQSLFYKLQYSDTSVATKELTKSFGWDTYDSFMQHDVQELNRVLCEKLEDKMKGTVVEGTIQQLFEGHHMNYIECINVDYKSTRKESFYDLQLDVKGCRDVYASFDKYVEVERLEGDNKYHAEQHGLQDAKKGVLFIDFPPVLQLQLKRFEYDFMRDTMVKINDRYEFPLQLDLDREDGKYLSPQADRSVRNLYTLHSVLVHSGGVHGGHYYAYIRPTLSDQWFNLMMSVLPKKT

SEQ ID NO: 4377 - protein, 1034 aa, Gossypium hirsutum
MANTDIPKGNNVDHLSMYLDVADSASLPYGWSRYAQFSLAVVNQIHSKYSIRKDTQHQFNARESDWGFTSFMPLGELYDPCRGYLVNDTLVVEAEVVVRKIVDYWAYDSKKETGYVGLKNQGATCYMNSLLQTLYHIPYFRKAVYHMPTTENDMPSGSIPLALQSLFYKLQYSDSSVATKELTKSFGWDTYDSFMQHDVQELNRVLCEKLEDKMKGTVVEGTIQQLFEGHHMNYIECINVDYKSTRKESFYDLQLDVKGCRDVYASFDKYVEVERLEGDNKYQAEQYGLQDAKKGVLFIDFPPVLQIQLKRFEYDFMRDTMVKINDRYEFPLQLDLDRDDGKYLSPEADRSVRNLYTLHSVLVHSGGVHGGHYYAYIRPTLSDQWYKFDDERVTKEDLKKALEEQYGGEELPQTNPGFNNTPFKFTKYSNAYMLVYIRESDKDKIICNVDEKDIAEHLRERLKKEQEEKEHKKKEKAEAHLYTIIKVARDDDLAEQIGKDICFDLVDHDKVRSFHIQKQMPFNVFKEEVAREFGIPVQFQRFWLWAKRQNHTYRPNRPLIPLEETQSVGALKEVSNKVHNAELKLFLEVELGLDLRPIAPPYKTKEDILLFFKHYDPEKEELRYVGRLFVKSAGKPIEILSRLNKMAGYAPDEDINLYEEIKFEPSVMCEPIDKKITFRASQLEDGDIVCFQKSLPVESTNQYRYPDVPSFLEYVHNRQVVHFRFLEKPKEDDFCLEMSRLYTYDDVVERVAQQLGLDDPTKIRLTSHNCYSQQPKPQPMKYRGVDHLSDMLFHYNQTSDILYFEVLDIPLPELQGLKTLKVAFHHATKDEVVIHTIRLPKQSTVGDVINDLKTKVELSHPDAELRLLEVFYNKIYKIFPPNEKIDNINDQYWTLRAEEIPEEEKNLGPNDRLIHVYHFTKETAQNQMQILNFGEPFFLVIHEGETLAEIKVRIQRKLQVPDEEFTKWKFAFLSLGRPEYLQDSDIVSSRFQRRDVYGAWEQYLGLEHSDNIPKRACAINQNRHTFEKPVKIYN

SEQ ID NO: 4378 - protein, 1131 aa, Populus trichocarpa
MTLMTPPPLNQQEDDEMLVPQTEFADGPQPMEVAQAETATAVDAQSVDDPPSARFTWTIDNFSRLNAKKLYSDVFVVGGYKWRILIFPKGNNVDHLSMYLDVADSATLPYGWSRYAQFSLTVINQLHQKYSIRKDTQHQFNARESDWGFTSFMPLGELYDPGRGYLVNDTCVVEADVAVRKVIDYWSHDSKKETGYVGLKNQGATCYMNSLLQTLYHIPYFRKAVYHMPTTENDIPSGSIPLALQSLFYKLQYSDTSVATKELTKSFGWDTYDSFMQHDVQELNRVLCEKLEDKMKGTVVEGTIQQLFEGHHMNYIECINVDYKSTRKESFYDLQLDVKGCRDVYASFDKYVEVERLEGDNKYHAEQHGLQDARKGVLFIDFPPVLQLQLKRFEYDFMRDTMVKINDRYEFPLQLDLDRENGKYLSPEADRSVRNLYTLHSVLVHSGGVHGGHYYAYIRPTLSDQWFKFDDERVTKEDIKRALEEQYGGEEELPQTNPGFNNSPFKFTKYSNAYMLVYIRESDKEKIICNVDEKDIAEHLRIRLKKEQEEKEQKRKEKAEAHLYTIIKVARSEDLLEQIGKDVYFDLVDHDKVRSFRIQKQITFNLFKEEVAKEFGIPVQLQRFWLWAKRQNHTYRPNRPLTPQEEAQSVGQLREVSNKANNAELKLFLEAEIGQDLRPVPPPEKTKDDILLFFKLYDPSKEELRYVGRLFVKGSGKPLEILTKLNEIAGFAPDQEIELYEASHYIYKYLSPVFFQEIKFEPNVMCEHIDKRLTFRSSQLEDGDIVCYQKPPPMGSDEQCRYPDVPSFLEYMHNRQVVRFRSLEKSKEDEFCLELSKLHTYDDVAERVAHHLGLDDPSKIRLTSHNCYSQQPKPQPIKFRGVDHLSDMLVHYNQTSDILYYEVLDIPLPELQGLKTLKVAFHHATKDEVVIHTIRLPKQSTVGDVINDLKAKVELSHPSAELRLLEVFYHKIYKIFPHNEKIENINDQYWTLRAEEVPEEEKNLAPHDRLIHVYHFMKDTTQNQVQVQNFGEPFFLVIHEGETLTEVKMRIQKKLQVPDEEFSKWKFAFLSLGRPEYLQDSDIVSSRFQRRDVYGAWEQYLGLEHSDNAPKRSYAANQNRHTFEKPVKIYN

SEQ ID NO: 4379 - protein, 1100 aa, Helianthus annuus
MLVPHSEFATAEGPQPMDVTPAEATNTVEASVVDDPPSAMFTWTIENFSRLTGKKLYSDVFFVGGYKWRVLIFPKGNNVDHLSMYLDVADSATLPYGWSRYAQFSLAVVNQVHNKFTMRKDTQHQFNARESDWGFTSFMPLSELYEPSRGYLLNDTCIIEADVTVRKVVDYWSHDSKKETGYVGLKNQGATCYMNSLLQTLYHIPYFRKAVYHMPTTENDMPSGSIPLALQSLFYKLQYSDTSVATKELTKSFGWDTYDSFMQHDVQELNRVLCEKLEDKMKGTVVEGTIQQLFEGHHMNYIECINVDYKSTRKESFYDLQLDVKGCRDVYASFDKYVEVERLEGDNKYHAEQHGLQDAKKGVLFIDFPPVLQLQLKRFEYDFMRDTMVKINDRYEFPLQLDLDRENGKYLSPHADRSVRNLYTLHSVLVHSGGVHGGHYYAYIRPTLSDQWLKFDDERVTKEDMKRALDEQYGGEEELPLANPGFNNSPFKFTKYSNAYMLVYIRESDKEKIICNVDEKDVAEHLRIRLKKEQEEKEQKRKEKAEAHLYTIIKVARDENLHEQIGKNIFFDLVDHDKVRSFRIQKQVSFALFKEEVAKELGIPVQCQRFWLWAKRQNHTYRPNRPLTPLEEAQSVGHLREVSNKANNAELKLFLEVELGQNSQPIPPPAKTKEEILLFFKLYDPLKEELRYVGRLFVKGTGKPTEILTKLNELAGFAPNEEIELFEEIKFEPNVMCEHVDKKLTFRASQLEDGDIICFQKPLQAGTVKCRYPDVPSFLEYVHNRQVVRFRSLEKPKEDEFSLELSKLHNYDDVVERVASHLNLDDPSKIRLTSHNCYSQQPKPQPIKYRGVEHLSDILAHYNQTSDILYYEVLDIPLPELQGLKTLKVAFHHATKDEVVIHTIRLPKQSTVGDVINDLKTKVELSHKDAELRLLEVFYHKIYKIFPLNEKIENINDQYWTLRAEEIPEEEKDLGPQDRLIHVYHFTKDTSQNQQVQNFGEPFFLVIREGETLAEVKLRIQKKLQVPDEEFSKWKFAFLSLGRPTYLQDSDVVSTRFQRRDVYGAWEQYLGLEHSDTTSKRSYAANQNRHTFEKPVRIYN

SEQ ID NO: 4380 - protein, 1118 aa, Vinca minor
MTLMTTPPVDPEEDEMLVPHSEFPVEGPQPMEVTPAPAEATTVDAQAAVDDPPSARFSWTIENFARLNTKKLYSEVFNVGGYKWRVLIFPKGNNVDHLSMYLDVADASALPYGWSRYAQFSLAVVNQVHNKFTVRKDTHHQFNARESDWGFTSFMPLSELYDPGRGYLVNDTCIVEADVAVRRVVDYWSHDSKKETGYVGLKNQGATCYMNSLLQTLYHIPYFRKAVYHMPTTENDMPSGSIPLALQSLFYKLQYSDTSVATKELTKSFGWDTYDSFMQHDVQELNRVLCEKLEDKMKGTVVEGTIQKLFEGHHMNYIECINVDYKSTRKESFYDLQLDVKGCRDVYASFDKYVEVERLEGDNKYHAEQYGLQDAKKGVLFIDFPPVLQLQLKRFEYDFVRDTMVKINDRYEFPLQLDLDRDNGKYLSPDADRSVRNLYTLHSVLVHSGGLHGGHYYAYIRPTLSDQWFKFDDERVTKEDMKRALEEQYGGEEELPHSNPGFNNSPFKFTKYSNAYMIVYIRESDKENIICNVDEKDIAEHLRIRLKKEQEEKEQKRKEKAEAHLYTIIKVARDEDLVEQIGKDIYFDLVDHDKVRCFRIQKQTPFNLFKEDVAKEFGIPVQCQRFWLWAKRQNHTYRPNRPLTPHEEAQSVGQLREVSNKANNAELKVFLEVDMSLELQPLPPPQKTKEEILLFFKLYDPVKEKLRYVGRMFVKGNGKPIEILSKLNELAGFAPDEEIDLFEEIKFEPNVMCEHIDKKLNFRSSQLEDGDIICFQKSLQGQNVEQSRYPDVPSFLEYVHNRQVVRFRSIEKPKEDEFSLELSKQNNYDEVVESVARHLSLDDPSKIRLTSHNCYSQQPKPQPIKYRGVEHLTDMLIHYNQTSDILYYEVLDIPLPELQGLKTLKVAFHHATKDEVVIHTIRLPKQSTVGDVINDLKTKVELSHPNAELRLLEVFYHKIYKIFPLHEKIENINDQYWTLRAEEIPEEDKNLGPHDRLIHVYHFMKDTSQNQVQVQNFGEPFFLAIHEGETLAEVKLRIQKKLQVPDEEFSKWKFAFLSLGRPEYLQDSDILSTRFQRRDVYGAWEQYLGLEHSDNAPKRSYAANQNRHTYEKPVRIYN

SEQ ID NO: 4381 - protein, 1098 aa, Prunus mume
MLVPHSEFPDGPQPMEEAQAETNNTVDAQSVDDPLSARFTWTIESFSRLNTKKLYSDIFLVGGYKWRILIFPKGNNVDHLSMYLDVADSGTLPYGWSRYAQFSLSIVNQLHSKYSIRKETQHQFNARESDWGFTSFMPLGELYDPGRGYIVNDTCIVEADVAVRRVIDYWSHDSKKETGYVGLKNQGATCYMNSLLQTLYHIPYFRKAVYHMPTTENDNPSGSIPLALQSLFYKLQYNDTSVATKELTKSFGWDAYDSFMQHDVQELNRVLSEKLEDKMKGTVVEGTIQQLFEGHQMNYIECINVDYKSTRKESFYDLQLDVKGCRDIYASFDKYVEVERLEGDNKYHAEQYGLQDAKKGVLFIDFPPVLQLQLKRFEYDFMRDTMVKINDRYEFPLQLDLDRENGKYLSPDADRSVRNLYTLHSVLVHSGGVHGGHYYAYIRPTLSDQWFKFDDERVTKEDMKRALEEQYGGEEELPQTNPGFNNAPFKFTKYSNAYMLVYIREIDKEKIICNVDEKDIAEHLRIRLKKEQEEKEQKRKEKAEAHLYTIIKVARNEDLLEQIGKNIYFDLVDHDKVHSFRIQKQMPFNLFKEEVAKEFGIPVQFQRFWLWAKRQNHTYRPNRPLTPLEETQSVGQLREVSNKSNNAELKLFLEIELGPDLLPLSPPEKTKEEILLFFKLYDPVKEELRYVGRLFVKGSGKPVELFAKLNEMAGFSPDEKIELFEEIKFEPNIMCEHIDEKATFRVSQLEDGDIICYQKSPQAGSSEQFRYPDVPSFLDYVRNRQVVRFRSLDKPKEDEFCLELSKFHTYDDVVERVAQHLGLDDPTKIRLTSHNCYSQQPKPQPIKFRGVEHLSDMLVHYNQTTDVLYYEVLDIPLPELQGLKTLKVAFHHATKDEVVVHTIRLPKQSSVGDVIDDLKTKVELSHPDAELRLLEVFYHKIYKIFPPNEKIENINDQYWTLRAEEIPEEEKNFGPHDRLIHVYHFMKDTAQNQVQNFGEPFFLVIREDETLAEVKVRVQKKLQVPDEEYSKWKFAFLSMGRPEYLQDDDIVASRFQRRDVYGAWEQYLGLEHTDHAPKRSHTTNQNRHTFEKPVKIYN

SEQ ID NO: 4382 - protein, 1118 aa, Cephalotaxus harringtonia
MTMMTPPPLDQQQEEEEMLVPHSEYNNEGAQPMEVVGQGETVSTVENQPSEDPPSSRFTWAIDNFSRLNVKKHYSDVFTVGGFKWRVLIFPKGNNVDQLSMYLDVADAATLPYGWSRQAQFSLAVVNQINSKYSIRKDTQHQFNARESDWGFTSFMPLGEIYDPLKGYLVNDALVVEADVVVRKVDSCWQYDSKKETGFVGLKNQGATCYMNSLLQTLYHVPYFRKAVYHMPTTENDMPSGSIPLALQSLFYKLQYSDSSVATKELTKSFGWDTYDSFMQHDVQELNRVLSEKLEDKMKGTVVEGTIQQLFEGHHMNYIECINVDYKSTRKESFYDLQLDVKGCRDVYASFDKYVEVERLEGDNKYHAEQHGLQDAKKGVLFIDFPPVLQLQLKRFEYDFMRDTMVKINDRYEFPLQLDLDRENGKYLSPDADRSVRNLYTLHSVLVHSGGVHGGHYYAYIRPTLSDQWFKFDDERVTKEDMKKALEEQYGGEEELPQTNPGFNNTPFKFTKYSNAYMLVYIRESDRDKIICNVDEKDIAEHLRVRLKKEQEEKEQKRKEKAEAHLYTIIKVARDEDLSEQIGKDIFFDLVDHDKVRSFRIQKQTPFIVFKEEVAKEFGIPVQFLRFWFWAKRQNHTYRPNRPLSLAEESQIVCHLREASNKTNNAELKLFLEIEPSPDLNPLPLPEKTNADILLFFKLYDPEKEELRYVGRSFVKALGKPTEILTKLNELAGFAPNEEIELFEEIKFEPNVMCEHIDKRLTFRGSQLEDGDIICYQRVISKEDEERFRFPDVPAFLEYVHNRQIVHFRCLEKPKEDDFCLELSKLYTYDDVVDRVAHKLGLVDPSKIRLTAHNCYSQQPKPQPIKYRGVDHLSDMLVHYNQTSDILYYEVLDIPLPELQGLKTLKVAFHHSTKDEVSVHTIRLPKQSTVGDVINDLKTKVDLSNPDAEIRLLEVFYHKIYKIFPLLEKIENINDQYWTLRAEEIPEEEKNLGPHDRLIHVYHFTKDASQNHMVQNFGEPFFLLIHEGETLAEVKQRIQKKLQVSDDEFAKWKFAFLSLGRPDYLQDTEIVSSRFQRRDVYGAWEQYLGLEHSDNAPKRSYQTNQNRHTFEKPVKIYN

SEQ ID NO: 4383 - protein, 1098 aa, Prunus persica
MLVPHSEFPDGPQPMEEAQAETNNTVDAQSVDDPLSARFTWTIESFSRLNTKKLYSDIFLVGGYKWRILIFPKGNNVDHLSMYLDVADSGTLPYGWSRYAQFSLSIVNQIHSKYSIRKETQHQFNARESDWGFTSFMPLGELYDPGRGYIVNDTCIVEADVAVRRVIDYWSHDSKKETGYVGLKNQGATCYMNSLLQTLYHIPYFRKAVYHMPTTENDNPSGSIPLALQSLFYKLQYNDTSVATKELTKSFGWDAYDSFMQHDVQELNRVLSEKLEDKMKGTVVEGTIQQLFEGHQMNYIECINVDYKSTRKESFYDLQLDVKGCRDIYASFDKYVEVERLEGDNKYHAEQYGLQDAKKGVLFIDFPPVLQLQLKRFEYDFMRDTMVKINDRYEFPLQLDLDRENGKYLSPDADRSVRNLYTLHSVLVHSGGVHGGHYYAYIRPTLSDQWFKFDDERVTKEDMKRALEEQYGGEEELPQTNPGFNNAPFKFTKYSNAYMLVYIREIDKEKIICNVDEKDIAEHLRIRLKKEQEEKEQKRKEKAEAHLYTIIKVARNEDLHEQIGKNIYFDLVDHDKVHSFRIQKQMPFNLFKEEVAKEFGIPVQFQRFWLWAKRQNHTYRPNRPLTPLEEAQSVGELREVSNKSNNAELKLFLEIELGPDLLPLSPPEKTKEEILLFFKLYDPVKEELRYVGRLFVKGSGKPVELFAKLNEMAGFSPDEKIELFEEIKFEPNIMCEHIDEKATFRVSQLEDGDIICYQKSPQAGSSEQFRYPDVPSFLDYVRNRQVVRFRSLDKPKEDEFCLELSKFHTYDDVVERVAQHLGLDDPTKIRLTSHNCYSQQPKPQPIKFRGVEHLSDMLVHYNQTTDVLYYEVLDIPLPELQGLKTLKVAFHHATKDEVVVHTIRLPKQSSVGDVIDDLKTKVELSHPDAELRLLEVFYHKIYKIFPPNEKIENINDQYWTLRAEEIPEEEKNFGPHDRLIHVYHFMKDTAQNQVQNFGEPFFLVIREDETLAEVKVRVQKKLQVPDEEYSKWKFAFLSMGRPEYLQDDDIVASRFQRRDVYGAWEQYLGLEHTDHAPKRSHTTNQNRHTFEKPVKIYN

SEQ ID NO: 4384 - protein, 770 aa, Theobroma cacao
MTVMTPAPVDQQEDEEMLVPHSDLTDNHQPMEVAAQPETASTVENQPVEDPPSSRFTWKIENFSRLNTKKHYSEVFPVGGFKWRILIFPKGNNVDHLSMYLDVADSASLPYGWSRYAQFSLAVVNQIHNKYSIRKDTQHQFNARESDWGFTSFMPLGELYDPCRGYLVNDTLIVEAEVIVRRIVDYWTYDSKKETGYVGLKNQGATCYMNSLLQTLYHIPYFRKAVYHMPTTENDMPSGSIPLALQSLFYKLQYSDSSVATKELTKSFGWDTYDSFMQHDVQELNRVLCEKLEDKMKGTVVEGTIQQLFEGHHMNYIECINVDYKSTRKESFYDLQLDVKGCRDVYASFDKYVEVERLEGDNKYQAEQYGLQDAKKGVLFIDFPPVLQLQLKRFEYDFMRDTMVKINDRYEFPLQLDLDRDEGKYLSPEADRSVRNLYTLHSVLVHSGGVHGGHYYAFIRPTLSDQWYKFDDERVTKEDMKRALEEQYGGEEELPQTNPGFNNTPFKFTKYSNAYMLVYIRESDKDKIICNVDEKDIAEHLRERLKKEQEEKEHKKKEKAEAHLYTIIKVARDDDLAEQIGKDIYFDLVDHDKVRSFRIQKQTPFNVFKEEVSKEYGIPIQFQRFWLWAKRQNHTYRPNRPLTPLEETQSVGALREVSNKAHNAELKLFLEVELGLDLRPIAPPDKTKEDILLFFKHYDPEKEELHFVGRLFVKSTGKPIEILSKLNKMAGYAPDQEIDLYEVCFCNFAFSVNFFQCLDILMKDNTLILL

SEQ ID NO: 4385 - protein, 1115 aa, Eutrema halophilum
MTMMTPPPVDQQEDEEMLVPHSDLVDGPTQPMEVTQPETPASTVENQPAEDPPTLKFTWTIPNFSRQNTRKHYSDVFVVGGYKWRILIFPKGNNVDHLSMYLDVSDAASLPYGWSRYAQFSLAVVNQIHTRYTIRKETQHQFNARESDWGFTSFMPLSELYDPSRGYLVNDTVFVEAEVAVRKVLDYWSYDSKKETGFVGLKNQGATCYMNSLLQTLYHIPYFRKAVYHMPTTENDAPTASIPLALQSLFYKLQYNDTSVATKELTKSFGWDTYDSFMQHDVQELNRVLCEKLEDKMKGTVVEGTIQRLFEGHHMNYIECINVDYKSTRKESFYDLQLDVKGCKDVYASFDKYVEVERLEGDNKYHAEGQGLQDAKKGVLFIDFPPVLQLQLKRFEYDFMRDTMVKINDRYEFPLQLDLDRENGKYLSPDADRSVRNLYTLHSVLVHSGGVHGGHYYAFIRPTLSDQWYKFDDERVTKEDLKRALEEQYGGEEELPQTNPGFNNPPFKFTKYSNAYMLVYIRESDKDKIICNVDEKDIAEHLRVRLKKEQEEKEDKRRYKAQAHLFTIIKVARDQDLKEQIGKDIYFDLVDHDKVRSFRIQKQTPFQQFKEEVAKEFGVPVQLQRFWIWAKRQNHTYRPNRPLTPQEELQPVGQIREASNKANTAELKLFLEVELLDERPIPPPEKSKEDILLFFKLYDPEKPELRYVGRLMVKSSSKPMDITGKLNEMAGFAPDEEIELFEEIKFEPCVMCEHLDKKTSFRLCQIEDGDIICFQKPLINKENECRYPAVPSFLEYVQNRQLVRFRALERPKEDEFVLELSKLHTYDDVVERVAQERGLDDPSKLRLTSHNCYSQQPKPQPIKYRGVDHLSDMLVHYNQTSDILYYEVLDIPLPELQGLKTLKVAFHHATKEEVVIHNIRLPKQSTVGDVINELKTKVELSHPDAELRLLEVFYHKIYKIFPLTERIENINDQYWTLRAEEIPEEEKNIGPNDRLILVYHFAKETGPNQQVQNFGEPFFLVIHEGETLEEIKNRIQKKLHVSDEDFAKWKFAFMSMGRPEYLQDSDVVYNRFQRREIYGAFEQYLGLEHTDTTPKRAYAANQNRHTYEKPVKIYN

SEQ ID NO: 4386 - protein, 1095 aa, Prunus mume
MTMMTPAPLDQQEDEEMLVPHSDLVEGPQPMEVAQVEPAASTVESQPVEDPPTMKFTWTIENFARLNTKKHYSDMFIVGGYKWRILIFPKGNNVDYLSMYLDVADSGTLPYGWSRYAHFSLAVVNQIHTKYSIRKDTQHQFNARESDWGFTSFMPLGDLYDPSRGYLVNDTVVVEAEVAVRKVLDYWSYDSKKETGYVGLKNQGATCYMNSLLQTLYHIPYFRKAVYHMPTTENDMPSGSIPLALQSLFYKLQYNDSSVATKELTKSFGWDTYDSFMQHDVQELNRVLCEKLEDKMKGTVVEGTIQQLFEGHHMNYIECINVDYKSTRKESFYDLQLDVKGCRDVYASFDKYVEVERLEGDNKYHAEEHGLQDAKKGVLFIDFPPVLQLQLKRFEYDFMRDTMVKINDRYEFPLQLDLDRENGKYLSPDSDKSVRNLYTLHSVLVHSGGVHGGHYYAFIRPTLSDQWYKFDDERVTKEDVKRALEEQYGGEEELPQTNPGFNNTPFKFTKYSNAYMLVYIRDSDKDKIICNVDEKDIAEHLRIRLKKEQEEKEDKRRYKAQAHLYTIIKVARDEDLAEQIGRDIYFDLVDHDKVRSFRIQKQTPFNLFKEEVAKEFGIPVQFQRFWIWAKRQNHTYRPNRPLTPQEELQSVGHLREVSNKTHNAELKLFLEVEFGPDLRPIPLPDKTKEDILLFFKLYEPEKRELRFVGRLFVKSSSKPVDILAKLIQLAGFGPDEEIELYEEIKFEPCIMCEHLDKRTSFRSSQIEDGDIICFQKSTPLESEEECKYPDVPSFLEYVHNRQIVHFRSLEKPKEEDFSLELSKLHTYDDVVEKVARQIGLEDPTKIRLTAHNCYSQQPKPQPIKYRGVEHLTDMLVHYNQSSDILYYEVLDIPLPELQGLKNLKVAFHHATKDEVVIHNIRLPKQSTVGDVINVLKTKVELSHPNAELRLLEVFYHKIYKIPEEEKNLAVHDRLIHVYHFTKDTAQNQMQVQNFGEPFFLVIHEGETLAEVKVRVQKKLQVPDDEFSKWKFAFLSLGRPEYLQDSDIVSSRFQRRDVYGAWEQYLGLEHSDNAPKRAYATNQNRHTYEKPVKIYN

SEQ ID NO: 4387 - protein, 1089 aa, Gossypium hirsutum
VDGPQPLEVAKEAASKVDAQAVDDPPSGRFTWTIENFSRLNTKKLYSDIFFVGGYKWRILIFPKGNNVDHLSMYLDVADSATLPYGWSRYAQFSLAVCNQIHNKYTIRKDTQHQFNVRESDWGFTSFMPLGELYDPSRGFLVNDTCVVEADVAVRKVADYWSHDSKKETGYVGLKNQGATCYMNSLLQTLYHIPYFRKAVYHMPTTENDMPTGSIPLALQSLFYKLQYSDTSVATEELTKSFGWDTYDSFMQHDVQELNRVLCEKLEDKMKGTVVEGTIQQLFEGHHMNYIECINVDYKSTRKESFYDIQLDVKGCKDVYASFDKYVEVECLEGDNRYHAEQFGLQDARKGVLFIDFPPVLQLQLKRFEYDFMRDTMVKINDRYEFPLQLDLDREDGKYLSPAADRSVRNLYTLHSVLVHSGGVHGGHYYAYIRPTLSDQWFKFDDERVTKEDVKRALEEQYGGEEELPQTNPGFNNTPFKFTKYSNAYMLVYIRESDKDKIICNVDEKDIAEHLRIRLKKEQEEKEQKRKEKAEAHLYTVIKVARNEDLVEQIGRDIYFDLVDHEKVRSFRIQKQMPFNVFKEEVAKEFGIPVQYQRFWLWAKRQNHTYRPNRPLTYQEEAQSVGQLREVSNKANNAELKLFLEVELGPDLQPVPPPEKTKEDILLFFKLYDPVKEELRYIGRMFVKGAGKPMEILARINKMAGFGPDEEIELYEEIKFEPNVMCEHIDKKLTFRTSQLEDGDIICLQKYSEVASEQCRYPDVPSFLEYVHNRQVVRFRSLEKPKEDEFSLELSKLHNYDDVVERVAHHLGLDDPSKIRLTSHNCYSQQPKPQPIKYRGVEHLSDMLIHYNQTSDILYYEVLDIPLPELQGLKTLKVAFHHATKDEVVIHTIRLPKQSTVGDVLDDLKTKVELSHPGAELRLLEVFYHKIYKIFPLSEKIENINDQYWTLRAEEIPEEEKDLGPHDRLIHVYHFMKDTTQNQQVQNFGEPFFLVIHETETLAEVKVRVQKRLQVPDEEFAKWKFAFLSLGRPEYLQDSDVVSTRFQRRDVYGAWDQYLGLEHSDNAPKRSYAANQNRHTFEKPVKIYN

SEQ ID NO: 4388 - protein, 1115 aa, Arabidopsis lyrata
MTMMTPPPVDQPEDEEMLVPNSDLVDGPAQPMEVIQPETAASTVENQPAEDPPTLKFTWTIPNFSRQNTRKHYSDVFVVGGYKWRILIFPKGNNVDHLSMYLDVSDAASLPYGWSRYAQFSLAVVNQIHSRYTIRKETQHQFNARESDWGFTSFMPLSELYDPSRGYLVNDTVLVEAEVAVRKVLDYWSYDSKKETGFVGLKNQGATCYMNSLLQTLYHIPYFRKAVYHMPTTENDLPTASIPLALQSLFYKLQYNDTSVATKELTKSFGWDTYDSFMQHDVQELNRVLCEKLEDKMKGTVVEGTIQQLFEGHHMNYIECINVDFKSTRKESFYDLQLDVKGCKDVYASFDKYVEVERLEGDNKYHAEGHGLQDAKKGVLFIDFPPVLQLQLKRFEYDFMRDTMVKINDRYEFPLELDLDRENGKYLSPDADRSVRNLYTLHSVLVHSGGVHGGHYYAFIRPTLSDQWYKFDDERVTKEDLKRALEEQYGGEEELPQTNPGFNNPPFKFTKYSNAYMLVYIRESDKDKIICNVDEKDIAEHLRVRLKKEQEEKEDKRRYKAQAHLYTIIKVARDEDLKEQIGKDIYFDLVDHDKVRSFRIQKQTPFQQFKEEVAKEFGVPVQLQRFWIWAKRQNHTYRPNRPLTPQEELQQVGQIREASNKANTAELKLFLEVEHLDLRPIPPPEKSKEDILLFFKLYDPEKAVLSYAGRLMVKSSSKPMDITGKLNEMVGFAPDEEIELFEEIKFEPCVMCEHLDKKTSFRLCQIEDGDIICFQKPLVNKEIECRYPAVPSFLEYVQNRQLVRFRALEKPKEDEFVLELSKLHTYDDVVEKVAEKLGLDDPSKLRLTSHNCYSQQPKPQPIKYRGVDHLSDMLVHYNQTSDILYYEVLDIPLPELQGLKTLKVAFHHATKEEVVIHNIRLPKQSTVGDVINELKTKVELSHPDAELRLLEVFYHKIYKIFPSTERIENINDQYWTLRAEEIPEEEKNIGPNDRLILVYHFAKETGQNQQVQNFGEPFFLVIHEGETLEEIKNRIQKKLHVSDEDFAKWKFAFMSMGRPEYLQDTDVVYNRFQRRDVYGAFEQYLGLEHADTTPKRAYAANQNRHAYEKPVKIYN

SEQ ID NO: 4389 - protein, 1116 aa, Brassica rapa
MTIMTPPPGDQQEDEEMLVPHSDLVDGTTQPMEVSETEAAVSTVENQQPAEDPPTLKFTWTVPNFSRQNTRKHYSDVFVVGGYKWRILIFPKGNNVDHLSMYLDVADAATLPYGWSRYAQFSLAVVNQIHTRYTIRKETQHQFNARESDWGFTSFMPLSELYDPSRGYLVNDTVFVEAEVAVRKVLDYWSYDSKKETGFVGLKNQGATCYMNSLLQTLYHIPYFRKAVYHMPTTENDAPTASIPLALQSLFYKLQYNDTSVATKELTKSFGWDTYDSFMQHDVQELNRVLSEKLEDKMKGTVVEGTIQQLFEGHHMNYIECINVDYKSTRKESFYDLQLDVKGCKDVYASFDKYVEVERLEGDNKYHAEGHGLQDAKKGVLFIDFPPVLQLQLKRFEYDFMRDTMVKINDRYEFPLELDLDRENGKYLSPDADRSVRNLYTLHSVLVHSGGVHGGHYYAFIRPTLSDQWYKFDDERVTKEDLKRALEEQYGGEEELPQTNPGFNNPPFKLTKYSNAYMLVYIRESDKDKIICNVDEKDIAEHLRIRLKKEQEEKEEKRKYKAQAHLFTIIKVARDQDLKEQIGKDIYFDLVDHDKVRSFRIQKQTPFQQFKEEVAKEFGVPVQLQRFWIWAKRQNHTYRPNRPLTPQEELQPVGQIREASNKANTAELKLFLEVELLVERPIPPPDKSKEDILLFFKLYDPEKQELRYVGRLMVKSSSKPMDITGKLNEMAGFAPDEEIELFEEIKFEPCVMCEHLDKKTSFKLCQIEDGDIICFQKPLGNKETECRYPAVPSFLEYVQNRQLVRFRALEKPKEDEFVLELSKLHTYDDVVERVAEKLGLDDPSKLRLTSHNCYSQQPKPQPIKYRGVDHLSDMLVHYNQTSDILYYEILDIPLPELQGLKTLKVAFHHATKEEVVIHNIRLPKQSTVGDVINELKTKVELSHPDAELRILEALYHKIYKIFPLTERIENINDQYWTLRAEEIPEEEKNIGPNDRLILVYHFAKETGQNQQVQNFGEPFFLVIHEGETLEEIKNRIQKKLHVSDEDFAKWKFAFMSMGRPEYLQDSDVVYNRFQRRDVYGAFEQYLGLEHTDTSPKRAYSANQSRHTYEKPVKIYN

SEQ ID NO: 4390 - protein, 915 aa, Brassica napus
MTIMTPPPGDQQEDEEMLVPHSDLVDGTTQPMEVSETEAAVSTVENQQPAEDPPTLKFTWTVPNFSRQNTRKHYSDVFVVGGYKWRILIFPKGNNVDHLSMYLDVADAATLPYGWSRYAQFSLAVVNQIHTRYTIRKETQHQFNARESDWGFTSFMPLSELYDPSRGYLVNDTVFVEAEVAVRKVLDYWSYDSKKETGFVGLKNQGATCYMNSLLQTLYHIPYFRKAVYHMPTTENDAPTASIPLALQSLFYKPQYNDTSVATKELTKSFGWDTYDSFMQHDVQELNRVLSEKLEDKMKGTVVEGTIQQLFEGHHMNYIECINVDYKSTRKESFYDLQLDVKGCKDVYASFDKYVEVERLEGDNKYHAEGHGLQDAKKGVLFIDFPPVLQLQLKRFEYDFMRDTMVKINDRYEFPLELDLDRENGKYLSPDADRSVRNLYTLHSVLVHSGGVHGGHYYAFIRPTLSDQWYKFDDERVTKEDLKRALEEQYGGEEELPQTNPGFNNPPFKFTKYSNAYMLVYIRESDKDKIICNVDEKDIAEHLRIRLKKEQEEKEEKRKYKAQAHLFTTIKVARDQDLKEQIGKDIYFDLVDHDKVRSFRIQKQTPFQQFKEEVAKEFGVPVQLQRFWIWAKRQNHTYRPNRPLTPQEELQPVGQIREASNKANTAELKLFLEVELLVERPIPPPDKSKEDILLFFKLYDPEKQELRYVGRLMVKSSSKPMDITGKLNEMAGFAPDEEIELFEEIKFEPCVMCEHLDKKTSFKLCQIEDGDIICFQKPLGNKETECRYPAVPSFLEYVQNRQLVRFRALEKPKEDEFVLELSKLHTYDDVVERVAEKLGLDDPSKLRLTSHNCYSQQPKPQPIKYRGVDHLSDMLVHYNQTSDILYYEVLDIPLPELQGLKTLKLLSIMPRRKRW

SEQ ID NO: 4391 - protein, 1110 aa, Eucalyptus grandis
MTLMTPPPLDQEDDEMLVPNTEFTEGPQPMEVQADAAGTVETQIADDPPSGRFTWTIENFSRLNTKKLYSEIFYVGGYKWRILIFPKGNNVDHLSIYLDVADSAALPYGWSRYAQFSLTVINQIHNKYSVRKETQHQFNARESDWGFTSFMHLSELYNPSRGYLVNDTCIVEADVEVRRIVDYWSHDSKKETGYVGLKNQGATCYMNSLLQTLYHIPYFKKAVYHMPTTENDMPSGSIPLALQSLFYKLQYSDTSVATKELTKSFGWDTYDSFMQHDVQELNRVLCEKLEDKMKGTVVEGTIQQLFEGHHMNYIECINVDYTSTRKESFYDLQLDVKGCRDVYASFDKYVEVERLEGDNRYHAEQHGLQDAKKGVLFIDFPPVLQLQLKRFEYDFMRDTMVKINDRYEFPLQLDLDRENGKYLSPEADRSVRNLYTLHSVLVHSGGVHGGHYYAYIRPTLSDQWFKFDDERVTKEDIKRALEEQYGGEEELPQTNPGFNSSPFKFTKYSNAYMLVYIRESDKEKIVCSVDEKDIAEHLRIRLKKEQEEKEKKRKEKAEAHLYTIIKVARDGDLHEQIGRDIYFDLVDHDKVRSFRIEKQKSFQVLKAEVFKEFGIPIECQRFWLWAKRQNHTYRPNRPLLPQEEGQSVGQLREVSNKQSAELKLFLEVELGQDLRPVPLLEKLKEEILLFFKLYDPLKEELRYVGRLFVKVNSKPAEILAKLNEMAGFSPDEEIDLFEEIKFEPNVMCEHVDKKLTFRASQLEDGDIVCYQKSKASSAEQYRYPDVPAFMEYVHNRQVVRFRSLEKPKEDEFSLELSKLHNYDDVVERVAHHLSLNDPSKIRLTPHNCYSQQPKPQPIKYRGAEHLCDMLVHYNQTSDILYYEVLDIPLPELQGLKTLKVAFHHATKDEVVIHSIRLPKQCTVGDVINDLKTKVDLSHPSAELRLLEVFYHKIYKIFPLNEKIENINDQYWTLRAEEIPEEEKNLGPHDRLIHVYHFMKDTTQNQVQNFGEPFFLVIHEGETLSDIKVRIQKKLQVPDEEFAKWRFAFLSLGRPEYLEDTDVLSTRFQRRDVYGAWEQYLGLEHTDNAPKRSYAVNQNRHTFEKPVRIYN

SEQ ID NO: 4392 - protein, 1085 aa, Gossypium raimondii
MLVPHNDFVDGPQPLEVAKEAASKVDAQAVDDPPSGRFTWTIENFSRLNTKKLYSDIFFVGGYKWRILIFPKGNNVDHLSMYLDVADSATLPYGWSRYAQFSLAVCNQIHNKYTIRKDTQHQFNVRESDWGFTSFMPLGELYDPSRGFLVNDTCVVEADVAVRKVADYWSHDSKKETGYVGLKNQGATCYMNSLLQTLYHIPYFRKAVYHMPTTENDMPTGSIPLALQSLFYKLQYSDTSVATKELTKSFGWDTYDSFMQHDVQELNRVLCEKLEDKMKGTVVEGTIQQLFEGHHMNYIECINVDYKSTRKESFYDLQLDVKGCKDVYASFDKYVEVECLEGDNRYHAEQFGLQDARKGVLFIDFPPVLQLQLKRFEYDFMRDTMVKINDRYEFPLQLDLDREDGKYLSPAADRSVRNLYTLHSVLVHSGGVHGGHYYAYIRPTLSDQWFKFDDERVTKEDVKRALEEQYGGEEELPQTNPGFNNTPFKFTKYSNAYMLVYIRESDKDKIICNVDEKDIAEHLRIRLKKEQEEKEQKRKEKAEAHLYTVIKVARNEDLVEQIGRDIYFDLVDHEKVRSFRIQKQMPFNVFKEEVAKEFGIPVQYQRFWLWAKRQNHTYRPNRPLTYQEEAQSVGQLREVSNKANNAELKLFLEVELGPDLQPVPPPEKAKEDILLFFKLYDPVKEELRYIGRMFVKGAGKPMEILARINKMAGFGPDEEIELYEEIKFEPNVMCEHIDKKLTFRTSQLEDGDIICLQKYSEVASEQCRYPDVPSFLEYVHNRQVVRFRSLEKPKEDEFSLELSKLHNYDDVVERVAHHLGLDDPSKIRLTSHNCYSQQPKPQPIKYRGVEHLSDMLIHYNQTSDILYYEVLDIPLPELQGLKTLKVAFHHATKDEVVIHTIRLPKQSTVGDVLDDLKTKVELSHPGAELRLLEVFYHKIYKIFPLSEKIENINDQYWTLRAEEIPEEEKELGPHDRLIHVYHFMKDATQNQQVQNFGEPFFLVIHETETLAEVKVRVQKRLQVPDEEFAKWKFAFLSLGRPEYLQDSDVVSTRFQRRDVYGAWDQYLGLEHSDNAPKRSYAANQV

SEQ ID NO: 4393 - protein, 571 aa, Vinca minor
MTLMTTPPMDPEEDEMLVPHSEFPVEGPQPMEVAPASAAAETTTVDAQAAVDDPPSARFTWTIENFTRLNTKKLYSEVFNVGGYKWRVLIFPKGNNVDHLSMYLDVADASALPYGWSRYAQFSLAVVNQVHNKFTVRKDTQHQFNARESDWGFTSFMPLSELYDPGRGYLVNDTCIIEADVAVRKVIDYWSHDSKKETGYVGLKNQGATCYMNSLLQTLYHIPYFRKAVYHMPTTENDMPSGSIPLALQSLFYKLQYSDTSVATKELTKSFGWDTYDSFMQHDVQELNRVLCEKLEDKMKGTVVEGTIQKLFEGHHMNYIECINVDYKSTRKESFYDLQLDVKGCRDVYASFDKYVEVERLEGDNKYHAEQHGLQDAKKGVLFIDFPPVLQLQLKRFEYDFVRDTMVKINDRYEFPLQLDLDRDNGKYLSPDADRSVRNLYTLHSVLVHSGGVHGGHYYAYIRPTLSDQWFKFDDERVTKEDMKRALEEQYGGEEELPQTNPGFNNSPFKFTKYSNAYMLVYIRESDKENIICNVDEKDIAEHLRIRLKKEQEEKESKEKGESRGTPLYYY

SEQ ID NO: 4394 - protein, 1116 aa, Brassica rapa
MTMVTPPPVDQQEDEEMLVPHSDLVEDPAQPMEVSETETAVSTVENQPAAEEPPTLKFTWTIPHFSRINTRKQYSDVFVVGGYKWRILIFPKGNNVDHLSMYLDVADAASLPYGWSRYAQFSLAVVNQVHTRYTIRKETQHQFNARESDWGFTSFMPLSELYDPSRGYLANDTVYIEAEVVVRKVLDYWSYDSKKETGFVGLKNQGATCYMNSLLQTLYHIPYFRKAVYHMPTTENDAPTASIPLALQSLFYKLQYNDTSVATKELTKSFGWDTYDSFMQHDVQELNRVLCEKLEDKMKGTVVEGTIQQLFEGHHMNYIECINVDYKSTRKESFYDLQLDVKGCKDVYASFDKYVEVERLEGDNKYHAEGHGLQDAKKGVLFIDFPPVLQLQLKRFEYDFMRDSMVKINDRYEFPLELDLDREDGKYLSPDADRSVRNLYTLHSVLVHSGGVHGGHYYAFIRPTLSDQWYKFDDERVTKEDLKRALEEQYGGEEELPQTNPGFNNPPFKFTKFSNAYMLVYIRESDKDKIICNVDEKDIAEHLRVRLKKEQEEKEDKRKYKAQAHLFTIIKVARDQDLKEQIGKDIYFDLVDHDKVRSFRIQKQTPFQQFKEEVAKEFGIPVQCQRFWIWAKRQNHTYRPNRPLTPQEELQPVGQIREASNKANTAELKLFLEVELLDERPIPPPEKSKEDILLFFKLYDPEKPELRYVGRLMVKSSSKPMDITGKLNEMAGFAPDEEIELFEEIKFEPGVMCEHLDKKNSFRLCQIEDGDIICFQKPVVNKETECRYPAVPLFLEYVQNRQLVRFRALEKPKEDEFVLELSKLHTYDDVVERVAEKLGLDDPSKLRLTSHNCYSQQPKPQPIKYRGVDRLSDMLVHYNQTSDILYYEVLDIPLPELQGLKTLKVAFHHSTKEEVVIHNIRLPKQSTVGDVINELKTKVELSHPDAELRILEVFYHKIYKIFPLTERIENINDQYWTLRAEEIPEEEKNIGPNDRLILVYHFAKETGQNQQVQNFGEPFFLVIHEGETLEEIKNRIQKKLHVSDEDFAKWKFAFMSMGRPEYLQDSDVVYNRFQRRDVYGAFEQYLGLEHTDTTPKRAYSANQNRHAYEKPVKIYN

SEQ ID NO: 4395 - protein, 1064 aa, Chelidonium majus
MTMMTPPPLDQEDDEMLVPHSDFADGPQPMEVVAQAETATTVENQPIEDPPTSRFTWTIENFSRLTTKKHYSDVFFVGGYKWRVLIFPKGNNVDHLSMYLDVADSANLPYGWSRYAQFSLAVVNQIHNKYTVRKDTQHQFNARESDWGFTSFMPLSELYDPGRGFLVNDTLLVEAEVVVRKVVDYWTYDSKKETGYVGLKNQGATCYMNSLLQTLYHIPYFRKAVYHMPTTENDMPSGSIPLALQSLFYKLQYSDNSVATKELTKSFGWDTYDSFMQHDVQELNRVLCEKLEDKMKGTVVEGTIQQLFEGHHMNYIECINVEYKSTRKESFYDLQLDVKGCRDVYASFDKYVEVERLEGDNKYHAEQHGLQDAKKGVLFIDFPPVLQLQLKRFEYDFMRDTMVKINDRYEFPLQLDLDRENGKYLSPDADRRVRNLYTLHSVLVHSGGVHGGHYYAFIRPTLSDQWFKFDDERVTKEDIKRALEEQYGGEEELPQTNPGFNNTPFKFTKYSNAYMLVYIRESDKDKIICNVDEKDIAEHLRIRLKKEARRKGSTRKRKKTEAHLYTIIKVARNEDLVEQIGRDIYFDLVDHDKVRSFRIQKQMPFNIFKEEVAKEFGIPVQFQRFWLWAKRQNHTYRPNRPLTQQEETQSVGHLREVSNKAHNAELKLFLEVELGLDLRPISPPEKTKEDILLFFKLYDPAKEALRFVGRLFVKGSGKPLEILTKLNELAGFAADEEIELYEEIKFEPSVMCEHIDKKLTFRASQLEDGDIICFQKSPPIERDERCRYPDVPTFLEYVHNRQVVHFRSLEKPKEDDFCLELSKNFTYDEVMERVARQLGLDDPTKIRLTSHNCYSQQPKPQPIKYRGVDHLSDMLVHYNQTSDILYYEVLDIPLPELQGLKTLKVAFHHATKDEVVIHSIRLPKQSTVGDVINDLKTKVELSQPNAELRLLEVFYHKIYKIFPPSEKIENINDQYWTLRAEEIPEEEKNLGPRDRLIHVYHFTKDASQNQMQVQNFGEPFFLIIHEGETLAEVKVRIQKKLQVPDEEFSKWKFAFLSLGRPEYL

SEQ ID NO: 4396 - protein, 1013 aa, Vitis vinifera
MYLDVADSATLPYGWSRYAQFSLSVVNQIHNKYSIRKDTQHQFNARESDWGFTSFMPLSDLYDPGRGYLVNDTCIIEAEVAVRKILDYWTYDSKKETGFVGLKNQGATCYMNSLLQTLYHIPYFRKAVYHMPTTENDMPSGSIPLALQSLFYKLQYNDNSVATKELTKSFGWDTYDSFMQHDVQELNRVLCEKLEDKMKGTVVEGTIQQLFEGHHMNYIECINVDYKSTRKESFYDLQLDVKGCRDVYASFDKYVEVERLEGDNRYQAENHGLQDAKKGVLFIDFPPVLQLQLKRFEYDFMRDTMVKINDRYEFPLQLDLDRENGKYLSPDADRSVRNLYTLHSVLVHSGGVHGGHYYAFIRPTLSDQWFKFDDERVTKEDTRRALEEQYGGEEELPQTNPGFNNTPFKFTKYSNAYMLVYIRESDKEKIICNVDEKDIAEHLRIRLKKEQEEKEDKRKYKAQAHLFTIIKVARDEDLAEQIGKDIYFDLVDHDKVRSFRIQKQWPFTLFKEEVAKEFGIPVQYQRFWIWAKRQNHTYRPNRPLTPQEEAQSVGQLREVSTKVNNAELKLFLEVELGPDLRPIPPPEKTKEDILLFFKLYDPEKEELRYVGRLFVKSSGKPIEILTKLNEMAGFAPDEEIELYEEIKFEPCVMCEHLAKRTSFRFSQIEDGDIICFQKSAPPESEEQCRYSDVTSFLEYVQNRQVVHFRALERPKEDDFCLELSKLHNYDDVVERVARRLGLDDPSKIRLTSHNCYSQQPKPQPIKYRGVEHLSDMLVHYNQSSDILYYEVLDIPLPELQGLKNLKVAFHHATKDDVIIHNIRLPKQSTVGDVINELKTKVELSHPNAELRLLEVFYHKIYKIFPPSEKIENINDQYWTLRAEEIPEEEKNLGPHDRLIHVYHFTKETVQNQMQVQNFGEPFFLIIHEGETLAEVKERIQKKLQVPDEEFSKWKFAFLSLGRPEYLQDSDIVSSRFQRRDVYGAWEQYLGLEHSDTAPKRAYAANQAAEGAPI

SEQ ID NO: 4397 - protein, 1115 aa, Brassica rapa
MTMITPAPVDQQEDEVMLVPHSDVVDGPAQPMEVSEAETAVSTVENQPAEEPPTLKFTWTIPNFSRQNTRKLYSDVFVVGGYKWRILIFPKGNNVDHLSMYLDVADAANLPYGWSRYAQFSLAVVNQIHTRYTIRKETQHQFNARESDWGFTSFMPLSELYDPGRGYLANDTVYVEAEVIVRKVLDYWSYDSKKETGFVGLKNQGATCYMNSLLQTLYHIPYFRKAVYHMPTTENDAPTASIPLALQSLFYKLQYNDTSVATKELTKSFGWDTYDSFMQHDVQELNRVLCEKLEDKMKGTVVEGTIQQLFEGHHMNYIECINVDYKSTRKESFYDLQLDVKGCKDVYASFDKYVEVERLEGDNKYHAEGHGLQDAKKGVLFIDFPPVLQLQLKRFEYDFMRDTMVKINDRYEFPLQLDLDREDGKYLSPDADRSVRNLYTLHSVLVHSGGVHGGHYYAFIRPTLSDQWYKFDDERVTKEDLKRALDEQYGGEEELPQTNPGFNNPPFKFTKYSNAYMLVSIRESDKDKIICNVDEKDIAEHLRVRLKKEQEEKEDKRKYKAQAHLFTIIKVARDQDLREQIGKDIYFDLVDHDKVRSFRIQKQTPFQQFKEEVAKEFGIPVQLQRFWIWAKRQNHTYRPNRPLTPQEELQPVGQIREASNKANTAELKLFLEVELLDERPIPPPEKSKEDILLFFKLYDPEKPELRYVGRLMVKSSSKPMDITGKLNEMAGFAPDEDLELFEEIKFEPGVMCEHLDKKTSFRLCQIEDGDIICFQKHLVKKETECRYPAVPLFLEYVQNRQLVRFRALEKPKEDEFVLELSKLHTYDDVVERVAQKLGLDDPSKLRLTSHNCYSQQPKPQPIKYRGVDRLSDMLVHYNQTSDILYYEVLDIPLPELQGLKTLKVAFHHATKEEVVIHNIRLPKQSTVGDVIDELKTKVELSHPDAELRLLEVFYHKIYKIFPLTERIENINDQYWTVRAEEIPEEEKNIGPNDRLILVYHFAKETGQNQQVQNFGEPFFLVIHEGETLEEIKNRIQKKLHVSDEDFAKWKFAFMSMGRPEYLQDSDVVYNRFQRRDVYGAFEQYLGLEHTDTTPKRAYSANQNRHTYEKPVKIYN

SEQ ID NO: 4398 - protein, 1116 aa, Brassica napus
MTMVTPPPVDQQEDEEMLVPHSDLVEDPAQPMEVSETETAVSTVENQPAAEEPPTLKFTWTIPHFSRINTRKQYSDVFVVGGYKWRILIFPKGNNVDHLSMYLDVADAASLPYGWSRYAQFSLAVVNQVHTRYTIRKETQHQFNARESDWGFTSFMPLSELYDPSRGYLANDTVYIEAEVVVRKVLDYWSYDSKKETGFVGLKNQGATCYMNSLLQTLYHIPYFRKAVYHMPTTENDAPTASIPLALQSLFYKLQYNDTSVATKELTKSFGWDTYDSFMQHDVQELNRVLCEKLEDKMKGTVVEGTIQQLFEGHHMNYIECINVDYKSTRKESFYDLQLDVKGCKDVYASFDKYVEVERLEGDNKYHAEGHGLQDAKKGVLFIDFPPVLQLQLKRFEYDFMRDSMVKINDRYEFPLELDLDREDGKYLSPDADRSVRNLYTLHSVLVHSGGVHGGHYYAFIRPTLSDQWYKFDDERVTKEDLKRALEEQYGGEEELPQTNPGFNNPPFKFTKYSNAYMLVYIRESDKDKIICNVDEKDIAEHLRVRLKKEQEEKEDKRKYKAQAHLFTIIKVARDQDLKEQIGKDIYFDLVDHDKVRSFRIQKQTPFQQFKEEVAKEFGIPVQCQRFWIWAKRQNHTYRPNRPLTPQEELQPVGQIREASNKANTAELKLFLEVELLDERPIPPPEKSKDDILLFFKLYDPEKPELRYVGRLMVKSSSKPMDITGKLNEMAGFAPDEEIELFEEIKFEPGVMCEHLDKKNSFRLCQIEDGDIICFQKPVVNKEIECRYPAVPLFLEYVQNRQLVRFRALEKPKEDEFVLELSKLHTYDDVVERVAEKLGLDDPSKLRLTSHNCYSQQPKPQPIKYRGVDRLSDMLVHYNQTSDILYYEVLDIPLPELQGLKTLKVAFHHSTKEEVVIHNIRLPKQSTVGDVINELKTKVELSHPDAELRILEVFYHKIYKIFPLTERIENINDQYWTLRAEEIPEEEKNIGPNDRLILVYHFAKETGQNQQVQNFGEPFFLVIHEGETLEEIKNRIQKKLHVSDEDFAKWKFAFMSMGRPEYLQDSDVVYNRFQRRDVYGAFEQYLGLEHTDTTPKRAYAANQNRHAYEKPVKIYN

SEQ ID NO: 4399 - protein, 1132 aa, Flaveria ramosissima
MTMVTPQPLDQEDEEMLVPHTELLDGPQPVQGPVAFDGTPPIEAPQPMEVVGQPEVASTAENQAADEPQASRFTWTIENFSRQTNKKLYSDVFMVGGYKWRVLIFPKGNNVDHLSMYLDVADSASLPYGWSRYAQFSLAVVNQIHNKFTIKKDTQHQFHARESDWGFTSFMPLSDLYDPSRGYLINDTCIIEADVAVRKVIDYWTYDSKKETGYVGLKNQGATCYMNSLLQTLYHIPYFRKAVYHMPTTENDMPSGSIPLALQSLFYKLQYNETSVATKELTKSFGWDTYDSFMQHDVQELNRVLCEKLEDKMKGTVVEGTIQKLFEGHHMNYIECVNVDFKSTRKESFYDLQLDVKGCRDVYASFDKYVEVERLEGDNKYHAEAHGLQDAKKGVLFIDFPPVLQLQLKRFEYDFTRDTMVKINDRYEFPLELDLDRENGKYLSPDADKSVRNLYTLHSVLVHSGGVHGGHYYAFIRPTLSDQWFKFDDERVTKEDMKRALEEQYGGEEELPQTNPGYNNAPFKFTKYSNAYMLVYIRESDKDKIICDVDEKDIAEHLRIRLKKEQEEKEDKRRYKAQAHLYTIIKVARDADLLEQIGKDIYFDLVDHDKVHNFRIQKQTPFNQFKEEVAKQFGVPVQFQRFWIWAKRQNHTYRPNRPLTALEETQSVGQLREVSNKNNNAELKLFLEIEIGPDLHPLPPPDKSKEDILLFFKLYDPEKEELRYVGRFFVKSSGKPTEIIVKLNERAGFSPDEEIELYEEIKFEPCVMCERLDKRSSFRSSQIEDGDIICFQKLPKAEEKYRYADVPSFLEYVKNRQMVHFRSLERPKEDDFCLELSKLHTYDDVVERVAQKLNLDDPSKIRLTPHNCYSQQPKPHHIKYRAAEHLLDMLVHYNQVSDILYYEVLDIPLPELQCLKTLKVAFHHANKEEPVIHNIRLPKQSTVGDVLNEIKSKVTLSHPDAELRLLEVFYHKIYKIFPLTEKIENINDQYWTLRAEEIPEEEKNLGPQDRLIHVYHFTKEAAQNQMQVQNFGEPFFLIIHENETLADVKIRIQRKLEVPDEEFSKWKFAFLSLGRPEYLQDSDVVSSRFQRRDVYGAWEQYLGLEHSDTTPKRSFTANQNRHTFEKPVKIYN

SEQ ID NO: 4400 - protein, 572 aa, Arnica chamissonis
MLVPHSDFAAADGPQPMEVAPAEAANTVEAPIADDPPSARFTWTIENFSRLIGKKLYSDVFIVGGYKWRVLIFPKGNNVDHLSMYLDVADSTTLPYGWSRYAQFSLAVVNQMHSKLTIRKDTQHQFNARESDWGFTSFMPLGELYELSRGYLVNDTCIVEADVAVRKVVDYWSHDSKKETGYVGLKNQGATCYMNSLLQTLYHIPYFRKAVYHMPTTENDMPSGSIPLALQSLFYKLQYSDTSVATKELTKSFGWDTYDSFMQHDVQELNRVLCEKLEDKMKGTVVEGTIQQLFEGHHMNYIECINVDYKSTRKESFYDLQLDVKGCRDVYASFDKYVEVERLEGDNKYHAEQHGLQDAKKGVLFIDFPPVLQLQLKRFEYDFMRDTMVKINDRYEFPLQLDLDRENGKYLSPQADRSVRNLYTLHSVLVHSGGVHGGHYYAYIRPTLSDQWLKFDDERVTKEDMKRAMDEQYGGEEELPQANPGFNNSPFKFTKYSNAYMLVYIRESDKEKIICNVDEKDVAEHLRIRLKKEQEEKEQKRKEKAEAHLYTIIKVARDENLHEQIGKNIFLI

SEQ ID NO: 4401 - protein, 1116 aa, Arabidopsis thaliana
MTMMTPPPVDQPEDEEMLVPNSDLVDGPAQPMEVTQPETAASTVENQPAEDPPTLKFTWTIPNFSRQNTRKHYSDVFVVGGYKWRILIFPKGNNVDHLSMYLDVSDAASLPYGWSRYAQFSLAVVNQIHTRYTVRKETQHQFNARESDWGFTSFMPLSELYDPSRGYLVNDTVLVEAEVAVRKVLDYWSYDSKKETGFVGLKNQGATCYMNSLLQTLYHIPYFRKAVYHMPTTENDAPTASIPLALQSLFYKLQYNDTSVATKELTKSFGWDTYDSFMQHDVQELNRVLCEKLEDKMKGTVVEGTIQQLFEGHHMNYIECINVDFKSTRKESFYDLQLDVKGCKDVYASFDKYVEVERLEGDNKYHAEGHGLQDAKKGVLFIDFPPVLQLQLKRFEYDFMRDTMVKINDRYEFPLELDLDREDGKYLSPDADRSVRNLYTLHSVLVHSGGVHGGHYYAFIRPTLSDQWYKFDDERVTKEDLKRALEEQYGGEEELPQTNPGFNNNPPFKFTKYSNAYMLVYIRESDKDKIICNVDEKDIAEHLRVRLKKEQEEKEDKRRYKAQAHLYTIIKVARDEDLKEQIGKDIYFDLVDHDKVRSFRIQKQTPFQQFKEEVAKEFGVPVQLQRFWIWAKRQNHTYRPNRPLTPQEELQPVGQIREASNKANTAELKLFLEVEHLDLRPIPPPEKSKEDILLFFKLYDPEKAVLSYAGRLMVKSSSKPMDITGKLNEMVGFAPDEEIELFEEIKFEPCVMCEHLDKKTSFRLCQIEDGDIICFQKPLVNKEIECLYPAVPSFLEYVQNRQLVRFRALEKPKEDEFVLELSKQHTYDDVVEKVAEKLGLDDPSKLRLTSHNCYSQQPKPQPIKYRGVDHLSDMLVHYNQTSDILYYEVLDIPLPELQGLKTLKVAFHHATKEEVVIHNIRLPKQSTVGDVINELKTKVELSHPDAELRLLEVFYHKIYKIFPSTERIENINDQYWTLRAEEIPEEEKNIGPNDRLILVYHFAKETGQNQQVQNFGEPFFLVIHEGETLEEIKNRIQKKLHVSDEDFAKWKFAFMSMGRPEYLQDTDVVYNRFQRRDVYGAFEQYLGLEHADTTPKRAYAANQNRHAYEKPVKIYN

SEQ ID NO: 4402 - protein, 1077 aa, Citrus sinensis
MTIMTPAPIDQQEDEEMLVPHSDLADNHQPMEVVAQPETANAVENNQPLDDPPSSRFTWRIENFSRLNTKKHYSEIFIVGGFKWRVLIFPKGNNVDHLSMYLDVADSSSLPYGWSRYAQFSLAVINQIHSKYSVRKDTQHQFNARESDWGFTSFMPLGELYDPNRGYLVNDTLIVEAEVIVRRVVDYWSYDSKKETGYVGLKNQGATCYMNSLLQTLFHIPYFRKAVYHMPTTENDMPSGSIPLALQSLFYKLQYSDSSVATKELTKSFGWDTYDSFMQHDVQELNRVLSEKLEDKMKGTVVEGTIQQLFEGHHMNYIECINVDYKSTRKESFYDLQLDVKGCRDVYASFDKYVEVERLEGDNKYHAEQYGLQDAKKGVLFIDFPPVLQLQLKRFEYDFMRDTMVKINDRYEFPLQLDLDRENGKYLSPDADRSVRNLYTLHSVLVHSGGVHGGHYYAFIRPTLSDQWYKFDDERVTKEDLKRALEEQYGGEEELPQTNPGFNNTPFKFTKYSNAYMLVYIRESDKDKIICNVDEQDIAEHLRERLKKEQEEKEHKKKEKAEAHLYTVIKVARDDDLLEQIGKDIYFDLVDHDKVRSFRIQKQIPFNLFKVGQLREVSNKVHNAELKLFLEVERGPDLRPIAPPEKTKEDILLFFKLYDPEKEELRYVGRLFVKSTGKPMEYLPKLNEMAGYAPDEEIDLYEEIKFEPSVMCEPIEKRCTFRASQLEDGDIICFQKSTPIEGVGKFRYPEVPSFLDYVHNRQVVHFRSLEKPKEDDFCLEMSKLYTYDDVVERVAQQLGLDDPSKIRLTSHNCYSQQPKPQPIKYRGVDHLSDMLIHYNQTSDVLYYEVLDIPLPELQCLKTLKVAFHHATKDEVSVHTIRLPKQSTVGDVINDLKTKVELSQPDAELRLLEVFYHKIYKIFPLNEKIENINDQYWTLRAEEIPEEEKNLGPHDRLIHVYHFTKETAQNQMQIQNFGEPFFLVIHEGETLQEIKVRIQRKLQVPDEEFAKWKFAFLSLGRPEYLQDTDIVSSRFQRRDVYGAWEQYLGLEHSDSAPKRAYAANQNRHTYEKPVKIYN

SEQ ID NO: 4403 - protein, 811 aa, Cucumis sativus
MLVPHSDVVEGPQPMEAQVEPSGTVENQQVEDPPPIKFTWRIENFSRLNMKKYYSDSFSVGGYKWRILVFPKGNNVDHLSMYLDVADSGTLPYGWSRYAQFSLAVVNQVHKKYSIRKDTKHQFNARESDWGFTSFMPLSDLYDPSRGYLVNDTCIVEAEVLVRKVLDYWSYDSKKETGYVGLKNQGATCYMNSLLQTLYHIPYFRKAVYHMPTTENDMPSGSIPLALQSLFYKLQFNASSVATKELTKSFGWDTYDSFMQHDVQELNRVLCEKLEDKMKGTVVEGTIQQLFEGHHMNYIECINVDYKSTRKESFYDLQLDVKGCNDVYASFDKYVEVERLEGDNKYHAEEHGLQEAKKGVLFIDFPPVLQLQLKRFEYDFMRDTMVKINDRYEFPLQLDLDRENGKYLSPEADRSVRNLYTLHSVLVHSGGVHGGHYYAFIRPTLSDQWYKFDDERVTKEDTKRALEEQYGGEEELPQTNPGFNNTPFKFTKYSNAYMLVYIRESDKDKIICNVDEKDIAEHLRIRLKKEQEEKEDKRKYKAQAHLYAIIKVARDVDLQEQIGKDIYFDLVDHDKVRSFRIQKQVPFNLFKEEVAKEYGIPVQFQRFWIWAKRQNHTYRPNRPLTPQEEAQSVGQLREASNKANNAELKLFLEVELGLDLHPIVPPEKNKDDILLFFKLYDPEKGELRYVGRLFVKSSTKPIEILEKLNKMAGFDPDQEIELFEEIKFEPCVMCEHLDKRTSFRLSQIEDGDIICFQKSPIDSEECRYPDVPSFLEYVHNRQVVHFRTLEKPKEDDFCLELSKVHVESSYL

SEQ ID NO: 4404 - protein, 976 aa, Prunus persica
MLVPHSDLVEGPQPMEVAQVEPAASTVESQPVEDPPTMKFTWTIENFARLNTKKHYSDMFIVGGYKWRILIFPKGNNVDYLSMYLDVADSGTLPYGWSRYAHFSLAVVNQIQTKYSIRKDTQHQFNARESDWGFTSFMPLGDLYDPSRGYLVNDTVVVEAEVAVRKVLDYWSYDSKKETGYVGLKNQGATCYMNSLLQTLYHIPYFRKAVYHMPTTENDMPSGSIPLALQSLFYKLQYNDSSVATKELTKSFGWDTYDSFMQHDVQELNRVLCEKLEDKMKGTVVEGTIQQLFEGHHMNYIECINVDYKSTRKESFYDLQLDVKGCRDVYASFDKYVEVERLEGDNKYHAEEHGLQDAKKGVLFIDFPPVLQLQLKRFEYDFMRDTMVKINDRYEFPLQLDLDRENGKYLSPDSDKSVRNLYTLHSVLVHSGGVHGGHYYAFIRPTLSDQWYKFDDERVTKEDVKRALEEQYGGEEELPQTNPGFNNTPFKFTKYSNAYMLVYIRDSDKDKIICNVDEKDIAEHLRIRLKKEQEEKEDKRRYKAQAHLYTIIKVARDEDLAEQIGRDIYFDLVDHDKVRSFRIQKQTPFNLFKEEVAKEFGIPVQFQRFWIWAKRQNHTYRPNRPLTPQEELQSVGHLREVSNKTHNAELKLFLEVEFGPDLRPIPLPDKTKEDILLFFKLYEPQKRELRFVGRLFVKSSSKPVDILAKLNQLAGFGPDEEIELYEEIKFEPCIMCEHLDKRTSFRLSQIEDGDIICFQKSTPLESEEECKYPDVPSFLEYVHNRQIVHFRSLEKPKEEDFSLELSKLHTYDDVVEKVARQIGLEDPTKIRLTAHNCYSQQPKPQPIKYRGVEHLTDMLVHYNQSSDILYYEVLDIPLPELQGLKNLKVAFHHATKDEVVIHNIRLPKQSTVGDVINVLKTKVELSHPNAELRLLEVFYHKIYKIFPHTEKIENINDQYWTLRAEEASSFPPFFFI

SEQ ID NO: 4405 - protein, 908 aa, Amorphophallus konjac
MNSLLQTLYHIPYFRKAVYHMPTTENDMPSGSIPLALQSLFYKLQYSDNSVATKELTKSFGWDTYDSFMQHDVQELNRVLCEKLEDKMKGTVVEGTIQHLFEGHHMNYIECINVDYKSTRKESFYDLQLDVKGCRDVYASFDKYVEVERLEGDNKYHAEQYGLQDAKKGVLFIDFPPVLQLQLKRFEYDFMRDTMVKINDRYEFPLQLDLDRDNGKYLSPEADRSVRNLYTLHSVLVHSGGVHGGHYYAFIRPTLSDQWFKFDDERVTKEDTKRALEEQYGGEEELPQTNPGFNNTPFKFTKYSNAYMLVYIRESDKEKIICNVDEKDIAEHLRVRLKKEQEEKEHKKKEKAEAHLYTVIKVARDEDLAEQIGREIYFDLVDHDKVRSFRIQKQMPFNLFKEEVAKEFGIPVQFQRFWLWAKRQNHTYRPNRPLTPQEEAQSVGLLREVSNKAHNAELKLFLEVEIGPDLRPLSPPEKTKEDILLFFKLYDPEKEELRYVGRLFVKTTGKPVEILKKLNEMAGFDSNEEIELYEEIKFEPSVMCEHIDKKLTFRSSQLEDGDIICYQKAPPLENDEMCRYPDVPSFLEYVHNRQVVHFRSLEKPKEDDFCLELSKLYTYDDVVERVAHHIGLDDPTKIRLTSHNCYSQQPKPQPIKYRGVEHLSDMLVHYNQTSDILYYEVLDIPLPELQGLKTLKVAFHHATKDEVVIHSIRLPKNSTVGDVINDLKTKVELSHPNAELRLLEVFYHKIYKIFPANEKIENINDQYWTLRAEEIPEEEKNIGPHDRLIHVYHFMKDPQNQMQVQNFGEPFFLVIHEGEALADVKERIQKKLQVSDEEFAKWKFAFLSLGRPEYLKDTDIVSHRFQRRDVYGAWEQYLGLEHSDTAPKRAYTTNQNRHTFEKPVRIYN

SEQ ID NO: 4406 - protein, 933 aa, Pennisetum glaucum
VDYWTYDSKKETGYVGLKNQGATCYMNSLLQTLYHIPYFRKAVYHMPTTENDMPSGSIPLALQSLFYKLQYSDNSVATKELTKSFGWDTYDSFMQHDVQELNRVLCEKLEDKMKGTVVEGTIEQLFEGHHINYIECINVDYKSSRKESFYDLQLDVKGCRDVYASFDKYVEVERLEGDNKYHAEQYGLQDAKKGVLFLDFPPVLQLQLKRFEYDYMRDTMVKINDRYEFPLQLDLDRDDGKYLSPDADRSIRNLYTLHSVLVHSGGVHGGHYYAFIRPTLSDQWYKFDDERVTKEDMKKALEEQYGGEEELPQINPGFNNTPFKFTKYSNAYMLVYIRESDKEKIMCNVDEKDIAEHLRIRLKKEQEEKEHKKKEKAEAHLYTIIKIARDEDLKDQIGKNIYFDLVDHEKVRSFRIQKQLPFTSFKEEVAKEYGIPVQFQRFWLWAKRQNHTYRPNRPLTPHEEAQSVGQLREVSNKAHNAELKLFLEVELGPELCPIRPPEKSKEDILLFFKLYDAEKEDLRFVGRLFVKALGKPSEILTKLNEMAGFSPNEEIELYEEIKFEPNVMCEHIDKKLTFRSSQLEDGDIICFQKAPVPDGDTQVRYPDVPSFLEYVHNRQVVHFRSLDKPKDDDFSLELSKLHTYDDVVEKVAHQLGLDDPSKIRLTSHNCYSQQPKPQPIRYRGVEHLLDMLVHYNQTSDILYYEVLDIPLPELQCLKTLKVAFHHATKDEVVVHSIRLPKNSTISDVITDLKTKVELSNPDAELRLLEVFYHKIYKIFPPHEKIENINDQYWTLRAEEIPEEEKNLGPHDRLIHVYHFMKDPNQNQQIQNFGDPFLMVIREGETAAEVMERIQRKLRVPDEEFSKWKLAFISMNRPEYLQDTDVVSARFQRRDVYGAWEQYLGLEHTDTTSKRSYTANQNRHTYEKPVKIYN

SEQ ID NO: 4407 - protein, 1114 aa, Solanum phureja
MTIMTPAPTDEEEEMLVPRSDLVFEGPQPMEAQAETGNDVEKQPPEDPQTSRFTWKIENFSRLNVKKLYSDPFVVGGYKWRILIFPKGNNVDYLSMYLDVAESANLPYGWSRYALFNLSIVNQIHNKYSIRKETQHQFNARESDWGFTSFMPLGELYDPNKGYLVDDTCVVDAEVAVRKIVDYWSYDSKKETGFVGLKNQGATCYMNSLLQTLYHIPYFRKAVYHMPTTENDMPSASIPLALQSLFYKLQYSDNSIATKELTKSFGWDTYDSFLQHDVQELNRVLCEKLEEKMKGTVVEGTIQQLFEGHHMNYIECINVDYKSTRKESFYDLQLDVKGCADVYASFDKYVEVERLEGDNKYHAEQYGLQDAKKGVLFMDFPPVLQLQLKRFEYDFSRDTMVKINDRYEFPLQLDLDRENGKYLSPEADGSVRNLYTLHSVLVHSGGVHGGHYYAFIRPTLSDQWYKFDDERVTKEDVKRALEEQYGGEEELPQTNPGFNNTPFKFTKYSNAYMLVYIRESDKEKIMCNVDEKDIAEHVRARLKREQEEKEQKKKEKAEAHLYTIIKVSRDEDLRQQIGKDIHFDLVDYDKVRSFRIQKQTLFSIFKEEVAKEFGVPVQSQRFWLWAKRQNHTYRPNRPLTHLEEAQTVGQLREVSNKVQNAELKLFLEVELGLDLRHITPPDKTKDDIMLFFKIYDPEKEELRYAGRLFVKGTSNPTEILNKLNEMAGYAPDQEIELYEEIKFEPIVLCEPIDKKFAFRTNQLEDGDIVCYQKSLSSESRQKLRYPDVPSFLEYVQNRQVVHFRSLEKLKEDDFCLELSKINTYDEVVERVAQRLGLDDPSKIRLTPHNCYSQQPKPQPIKYRGVDTLGDMLVHYNQTSDILYYEVLDIPLPELQGLKTLKVAFHHATKDEVVTYTIRLPKQSTVGDVINDLKTKVEFSKPDAELRLLEVFYHKIYKIFPTSEKIENINDQYWTLRAEEIPEEEKNLGPNDRLIHVYHFTKETAQNQMQIQNFGEPFLLVIYEGETLAQVKVRIQKKLQVPDEEFAKWKFAFLSLGRPEYLEDSDILSNRFQRKDVYGAWEQYLGLEHPDNAPKRIHAAYQNRPTYEKPVKIYN

SEQ ID NO: 4408 - protein, 975 aa, Malus domestica
MLVPHSDVVEGPQPMEVAQVEPASTVDSQPVEDPPTMKFTWTIENFTRLNTKKHYSDTFVVGGYKWRILIFPKGNNVDYLSMYLDVADSGTLPYGWSRYAHFSLAVVNQIHTKYSIRKDTQHQFNARESDWGFTSFMLLGDLYDLSRGYLVNDTVVVEAEVAVRKVLDYWSYDSKKETGYVGLKNQGATCYMNSLLQTLYHIPYFRKAVYHMPTTENDMPSGSIPLALQSLFYKLQYNDSSVATKELTKSFGWDTYDSFMQHDVQELNRVLCEKLEDKMKGTVVEGTIQQLFEGHHMNYIECINVDYKSTRKESFYDLQLDVKGCRDVYASFDKYVEVERLEGDNKYHAEEHGLQDAKKGVLFIDFPPVLQLQLKRFEYDFMRDTMVKINDRYEFPLQLDLDRENGKYLSPDSDKSVRNLYTLHSVLVHSGGVHGGHYYAFIRPTLSDQWYKFDDERVTKEDVKRALEEQYGGEEELPQTNPGFNNTPFKFTKYSNAYMLVYIRDSDKDKIICNVDEKDIAEHLRIRLKKEQEEKEDKRRYKAQAHLYTIIKVARDEDLTEQIGRDIYFDLVDHDKVHSFRIQKQMPFNLFKEEVAKAFGIPVQFQRFWIWAKRQNHTYRPNRPLTPQEETQSVGQLREVSNKTNNAELKLFLEVAFGLDLRPIPPLDKTKEDILLFFKLYEPEKRELRFVGRFFVKSSSKPAEILGKLNQLAGFAPEEEIELYEEIKFEPCIMCEHLDKKTSFRLSQIEDGDIICFQKSTPLKSEEECKYPDVPSFLEYVHNRQVVHFRSLEKPKEEDFSLELSKQHTYDDVVEKLARQIGLDDPTKIRLTAHNCYSQQPKPQPIKFRGVEHLTDMLVHYNQSSDILYYEVLDIPLPELQGLKNLKVAFHHATKDEVVIHNIRLPKQSTVGDVINVLKTKVELSHPNAELRLLEVFYHKIYKIFPHGEKIENINDQYWTLRAEEASSFRPLFFI

SEQ ID NO: 4409 - protein, 533 aa, Distylium racemosum
MLVPHPEFNNSNNNNDAIAPMEATVGRPETVTVSTAENRPIIEDPPTSKFTWTIEHFSRLNVRKHYSEYFIVGGYKWRILVFPKGNNVDQVSMYLDVADSSILPYGWSRYAHFSWQLSIRFIRSILSEKKPNINLMLERVIGVSHHLCRFWTFTIRKGYLVNDTLVVEAEVTVQRVLDYWTYDSKKETGFVGLKNQGATCYMNSLLQTLYHMPYFRKAVYHMPTTENDAPSSSIPLALQSLFYKLQYSDTSVSTKDLTKSFGWDTYDSFMQHDVQELNRVLCEKLEDKMKGTAVEGTIQQLFEGHHMNYIECINVDYKSTRKESFYDLQLDVKGCRDVYASFDKYVEVEKLEGDNKYHAENYGLQEAQKGVLFIDFPPVLQLQLKRFEYDFMRDMMVKINDRYEFPLQLDLDRENGRYLSPDADRSVRNLYTLHSVLVHSGGVHGGHYYAFIRPTLSDQWYKFDDERVTKEETKRALEEQYGGEEELPQTNPGSTTHLLSSQSIQMLTCSFMLERVIRTKLFAMLMRRILQSI

SEQ ID NO: 4410 - protein, 1123 aa, Mimulus guttatus
MTMMTPQPLDQQEDEEMLVPHSDLVEGPQPLVQGPQPMEVAPSDNAGTTENQANDEPQASRFTWTIDAFSRVNNKKLYSDAFAVGGYKWRVLIFPKGNNVDYLSMYLDVADSANLPYGWNRYAQFSLAVVNQMHSKLTIKKDTQHQFNQRESDWGFTSFMPLSELYDPNKGYLVNDTVVIEADVAVRKVVDYWTYDSKKETGYVGLKNQGATCYMNSLLQTLYHIPYFRKAVYHMPTTENDNPTGSIPLALQSLFYKLQYNDTSVATKELTKSFGWDTYDSFMQHDVQELNRVLCEKLEDKMKGTVVEGTIQKLFEGHHMNYIECINVDFKSTRKESFYDLQLDVKGCKDVYASFDKYVEVERLEGDNKYQAEGHGLQDAKKGVLFMDFPPVLQLQLKRFEYDFMRDTMVKINDRYEFPLELDLDRDNGKYLTPEADRGIRNLYTLHSVLVHSGGVHGGHYYAFIRPTLSDQWYKFDDERVTKEDMKRALEEQYGGEEELPQTNPGYNNTPFKFTKYSNAYMLVYIRVSDKDKIICDMDEKDIAEHLRIRLKKEQEEKEDKKRYKAQAHLYTIIKVARDEDLREQIGKDIYFDLVDHDKVCNFRIQKQMPFNQFKEEVAKELGIPVQFQRFWIWAKRQNHTYRPNRPLTAQEEAQTVGALREVSSKAHNAELKLFLEVHHGLDLQPVPPPEKNKEDILLFFKLYDPEKEELRYIGRFFVKNTGKPIEILARINEMAGFAPDEEIDLFEEIKFEPTVMCERLDKKASFRFSQIEDGDIICFQKRPLPEHEEKIRFPDVPSFLEYVKNRQIVHFRALEKPKEDEFCLELAKNHTYDDVVEKVAQRLGLDDPSKIRLTPHNCYSQQPKPNPIKYRSVDHLLDMLVHYNQISDILYYEVLDIPLPELQCLKTLKVAFHHATKEEAVILNIRLPKQSTVGDVLNEIKTKVELSHPNSELRLLEVFYHKIYKIFPLHEKIENINDQYWTLRAEEIPEEEKNLGPNDRLIHVYHFNKEIAQNQLQVQNFGEPFFLVIHEGDTLADVKVRIQKKLLVSDEEFSKWKFAFLSLGRPEYLEDSDIVSSRFQRRDVYGAWEQYLGLEHSDTTPKRAYAANQNRHTFEKPVKIYN

SEQ ID NO: 4411 - protein, 1085 aa, Gossypium raimondii
NLVAQVEPASTVENQQVEEPPSMKFTWTIENFSRLNTKKHYSDIFVVGGYKWRILIFPKGNNVDHLSMYLDVADSSALPYGWSRYAQFSLAVVNQIHHKYSIRKDTQHQFNARESDWGFTSFMPLSDLYDPSRGYLVNDTVVVEAEVAVRKILDYWSYDSKKETGYVGLKNQGATCYMNSLLQTLYHIPYFRKAVYHMPTTENDMPIGSIPLALQSLFYKLQYNDTSVATKELTKSFGWDTYDSFMQHDVQELNRVLCEKLEDKMKGTVVEGTIQQLFEGHHMNYIECINVDYKSTRRESFYDLQLDVKGCRDVYASFDKYVEVERLEGDNKYHAEEHGLQDAKKGVLFIDFPPVLQLQLKRFEYDFMRDTMVKINDRYEFPLQLDLDREDGKYLSPDADRSVRNLYMLHSVLVHSGGVHGGHYYAFIRPTLSDQWYKFDDERVTKEDMKRVLEEQYGGEEELPQTNPGFNNTPFKFTKYSNAYMLVYIRESDKDKIICNVDEKDIAEHLRMRLKKEQEEKEDRRRYKAQAHLYTIIKVARDEDLLEQIGKDIYFDLVDHDKVRSFRIQKQTSFLAFKEEVAKEFGIPLQYQRFWIWAKRQNHTYRPNRPLTPQEEAQSVGQLREVSSKAHNAELKLFLEVERGQDLHPIPPPDKTRDDILLFFKLYDPEKGELRYVGRLLVKLSGKPIDYIAKLNQMAGFSPDEEIELYEEIKFEPCVMCEHLDKRCSFRLSQIEDGDIICFQKSSPIQSEEACRCPDVPSFLEYVHNRQIVRFRSLERPKEDDFCLELSKIHTYDDVVERVAYKIGLDDPSKIRLTSHNCYSQQPKPQPIKYRGVEHLSEMLVHYNQTSDILYYEVLDIPLPELQGLKNLKVAFHHATKEEVVIHNIRLPKQSTVGDVIDELKTKVELSHPNAELRLLEVFYHKIYKIFPPSEKIENINDQYWTLRAEEIPEEEKNLGPNGRLIHVYHFTKETAQNQMQIQNFGEPFFLVIHEGETLAEVKVRIQKKLQVPDEEFSKWKFAFMSLSRPEYLQESDIVFNRFQRRDVYGAWEQYLGLEHSDNTPKRAYVNQNRHTYEKAVKIYN

SEQ ID NO: 4412 - protein, 1090 aa, Silene vulgaris
DNQPMEVVASAEPANTLETPPAEDPPTARFTWKIENFTRLNTKKHYSAVFLGGEHKWRILIFPKGNNVDYLSMYLDVADSASLPYGWSRYAQFSLAVVNQVHNKYSVRKDTQHQFNARESDWGFTSFMALSELYDPSRGYLVNDTVIIEAEVVVRKIVDYWSYDSKKETGFVGLKNQGATCYMNSLLQTLFHIPYFRKAVYHMPTTEIDMPSASIPLALQSLFYKLQYSDGSVATKELTKSFGWDTYDSFMQHDVQELNRVLCEKLEDKMKGTVVEGTIQKLFEGHHMNYIECVNVDYKSTRKESFYDLQLDVKGCRDVYASFDKYVEVEKLDGDNKYHAEQYGLQDARKGVLFIDFPPVLQLQLKRFEYDFMRDTMVKINDRYEFPLELDLDRENGKYLSPDADRSVRNLYTLHSVLVHSGGVHGGHYYAYIRPTLSEQWYKFDDERVTKEDMKRALDEQFGGEEELPQTNPGFNNAPFKFTKYSNAYMLVYIRESDKDKILCNVDEKDIAEHLRERLNREQDEKEFKKKEKAEAHLYTIIKVARDDDLSEQIGKDIYFDLVDHDKVKSFRVQKQMPFNLFKEEVAKEFGIPVQLQRFWLWAKRQNHTYRPNRPLTALEEAQTVGQLREVSNKAQNAELKLLLEVELDYDLRPIAPPEKTKDEILLFFKHYDPAKEELRYVGRLFVKANGKPGEILGKLKEMAGYAAEEEIELFEEIKFEPTVMCEHIDLKLTFRGSQLEDGDIVCFQKTLPAETAGRYRYPGVPSFLDYVQNRQVVHFRSLERPKEDDFCLELSRHHTYDDVVERVSRQLGLDDPSKIRLTSHNCYSQQPKPQPIKYRGVDHLTDMLVHYNQTSDILYYEVLDIPLPELQGLKTLKVAFHHASKDEVVIHTRLPKHSTVGDVLNDLKTKVELSHPDAELRLLEVFYHKIYKIFPPNEKIENINDQYWTLRAEEIPEEEKNLGPQDRLIHVYHFTKETAQNQTQIQNFGEPFFLVIHEGETLADVKGRIQKKLQVPDEEFSKWKFAFLSLGRPEYLQDTDIVSSRFQRRDVYGAWEQYLGLEHPDTTPKRINTANQNRHNFEKPVKIYN

SEQ ID NO: 4413 - protein, 1114 aa, Solanum lycopersicum
MTIMTPAPTDEEEEMLVPRSDLVFEGPQPMEAQAETGNDVEKQPPEDPQTSRFTWKIDNFSRLNVKKLYSDPFVVGGYKWRILIFPKGNNVDYLSMYLDVADSANLPYGWSRYAQFNLSIVNQIHNKYSIRKETQHQFNARESDWGFTSFMPLGELYDPNKGYLVDDTCVVDAEVAVRKIVDYWSYDSKMETGFVGLKNQGATCYMNSLLQTLYHIPYFRKAVYHMPTTENDMPSASIPLALQSLFYKLQYSDNSVATKELTKSFGWDTYDSFLQHDVQELNRVLCEKLEEKMKGTVVEGTIQQLFEGHHMNYIECINVDYKSTRKESFYDLQLDVKGCADVYASFDKYVEVERLEGDNKYHAEQYGLQDAKKGVLFMDFPPVLQLQLKRFEYDFSRDTMVKINDRYEFPLQLDLDRENGKYLSPEADGSVRNLYTLHSVLVHSGGVHGGHYYAFIRPTLSDQWYKFDDERVTKEDVKRALEEQYGGEEELPQTNPGFNNTPFKFTKYSNAYMLVYIRECDKEKIMCNVDEKDIAEHLRARLKREQEEKEQKKKEKAEAHLYTIIKVSRDEDLRQQIGKDIHFDLVDYDKVRSFRIQKQTLFSIFKEEVAKEFGVPVQSQRFWLWAKRQNHTYRPNRPLTHLEEAQTVGQLREASSKVQNAELKLFLEVELGLDLRHIPPPDKTKDDIMLFFKIYDPEKEELRYAGRLFVKGTSNPTEILNKLNEMAGYAPDQEIELYEEIKFEPIVLCEPINKKFAFRTNQLEDGDIVCYQKSLSPESRQKLRYPDVPSFLEYVQNRQVVHFRYLEKLKEDDFCLELSKINTYDEVVERVAQRLGLDDPSKIRLTPHNCYSQQPKPQPIKYRGVDTLGDMLVHYNQTSDILYYEVLDIPLPELQGLKTLKVAFHHATKDEVVTYTIRLPKQSTVGDVINDLKTKVELSNPDAELRLLEVFYHKIYKIFPTSEKIENINDQYWTLRAEEIPEEEKNLGPNARLIHVYHFSKETAQNQMQIQNFGEPFLLVIHEGETLVQVKVRIQKKLQVPDEEFAKWKFAFLSLGRPEYLEDSDILFNRFQRKDVYGAWEQYLGLEHSDNAPKRINAAYQNRPTYEKPVKIYN

SEQ ID NO: 4414 - protein, 1010 aa, Silene vulgaris
MLVPHSDVVVEGPQPMEVAQADANNGTENQAIEEPPTSKFTWTIEHFTRINTKKHYSEAFVVGGYKWRILIFPKGNNVDYLSMYLDVADSQALPYGWSRYAGFSLTVVNQLHQKYSIRKETQHQFNSRENDWGFTSFMPLSELYDPSRGYLANDTVVIEAEVAVRRAMDYWSYDSKKETGCVGLKNQGATCYMNSLLQTLYHIPYFRKAVYHMPTTENDNPANSIPLALQSLFYKLQYNDTSVSTKGLTKSFGWDSYDSFMQHDVQELNRVLCEKLEDKMKGTVVEGTIQMLFEGHHMNYIECVNVDYKSTRKESYYDLQLDVKGCKDVYASFDKYVEVERLEGDNKYHAEEHGLQDAKKGVLFLDFPPVLQLQLKRFEYDFMRDTMVKVNDRYEFPLQLDLDRDDGKYLAPGADRSVRNLYTLHSVLVHSGGVHGGHYYAYIRPTLSDQWFKFDDERVTKEDIKRALEEQYGGEEELPQTNPAFNNTAFKFTKYSNAYMLVYIRESDKDKVVCDVDEKDIAEHLRTRLKKEQEEKEEKRKYKAQAHLYTIIKVARDDDLAEQIGRDIYFDLVDHEKVRSFRIQKQMPFNLFKEEVAKEFGIPVEFQRYWIWAKRQNHTYRPNRPLRPAEEAQPVGQLREASKAGNIVPELKLFLDVEIGLDLRPLPPPDKTKDDILLFFKLYDPEKEELRYVGRLFVKSAGKPVEILAKLNEMAGFAPEEEIDVFEEIKFEPCVMCEHLDKRQSFRQSQLEDGDIICFQKALPIDHEERYRYPDVPSFLEYVHNRQVVHFRSLEKPKEDDFCLELSKINTYDEVVERVAKQLGLDDPSKIRLTSHNCYSQQPKPQPIKYRGVDHLTDMLAHYQQSSDILYYEVLDIPLPELQGLKNLKVAFHHATKEEVVIHNVRLPKQSTVGDVINELKTKVELSRPDAELRLLEVFYHKIYKIFPPNEKIENINDQYWTLRAEEIPEEEKNLEPHDRLIHVYHFTKDAAQNQMQVQNFWRSLFLGNS

SEQ ID NO: 4415 - protein, 1062 aa, Papaver somniferum
PTSRFTWTIESFSRLNVKKHYSDVFVVGGFKWRVLIFPKGNNVDQLSMYLDVADSQNLPYGWSRYAQFSLAVVNQSQNKFTVRKDTQHQFNARESDWGFTSFMPLSDLYDPSRGFLANDTVIIEAEVIVRKVVDYWSYDSKKETGFVGLKNQGATCYMNSLLQTLYHIPYFRKAVYHMPTTENDMPSGSIPLALQSLFYKLQYSDNSVATKELTKSFGWDTYDSFMQHDVQELNRVLSEKLEDKMKGTVVEGTIQQLFEGHHMNYIECINVDYKSTRKESFYDLQLDVKGCRDVYASFDKYVEVERLEGDNKYHAEQHGLQDAKKGVLFIDFPPVLQLQLKRFEYDFMRDTMVKINDRYEFPLQLDLDRENGKYLSPDADRGVRNLYTLHSVLVHSGGVHGGHYYAFIRPTLSDQWFKFDDERVTKEDMKRALEEQYGGEEELPNAGFNNTPFKFTKYSNAYMLVYIRDSDKDKIICNVDEKDIAEHLRVRLKKEQEEKEHKKKEKAEAHLYTIIKVARNEDLKEQIGRDIYFDLVDHDKVRSFRIQKQMSFNVFKEEVAKEFGIPVECQRFWLWAKRQNHTYRPNRPLTHQEETQSVGHLREVSNKAHNAELKLFLEVEVGLDLRPIPPPEKTKDDILIFFKLYDSEKEALRFVGRLFVKGSGKPLEILSKLNEMAGFAPSEEIELYEEIKFDPSVMCEHIDKKLTFRTSQLEDGDIICFQKSPSTEPEQRHRYPDVPSFLEYVHNRQVVHFRSLEKPKEDDFCLELSKIFSYDEVVEKVAQQLGLEDPSKIRLTSHNCYSQQPKPQPIKYRGVDRLSDMLVHYNQTSDILYYEVLDIPLPELQGLKTLKVAFHHATKEEAVIHCIRLPKQSTVGDVINDLKTKVELSHPGAELRLLEVFYHKIYKIFPLNEKIENINDQYWTLRAEEIPEEEKNLGPNDRLIHVYHFTKDTTQMQVQNFGEPFFLLIHEGETLADVKGRIQKKLQVPDEEFAKWRFAFLSLGRPDYLEDSDVVSSRFQKRDIYGAWEQYLGLEHSDSAPKRAYAANQNRHTYEKPVKIYN

SEQ ID NO: 4416 - protein, 1115 aa, Arabidopsis lyrata
MTMMTPPPLDQQEDEEMLVPNPDLVEGPQPMEVAQTEPAASAVENPPPEDPPTLKFTWTIPIFTRLNTRKHYSDVFVVGGYKWRILIFPKGNNVDHLSMYLDVADAANLPYGWSRYSQFSLAVVNQVNNRYSIRKETQHQFNARESDWGFTSFMPLSELYDPTRGYLVNDTVLIEAEVAVRKVLDYWSYDSKKETGFVGLKNQGATCYMNSLLQTLYHIPYFRKAVYHMPTTENDAPTASIPLALQSLFYKLQYNDTSVATKELTKSFGWDTYDSFMQHDVQELNRVLCEKLEDKMKGTVVEGTIQKLFEGHHMNYIECINVDYKSTRKESFYDLQLDVKGCKDVYASFDKYVEVERLEGDNKYHAEGHDLQDAKKGVLFIDFPPVLQLQLKRFEYDFMRDTMVKINDRYEFPLQLDLDRENGKYLSPDADKSVRNLYTLHSVLVHSGGVHGGHYYAFIRPTLSDQWYKFDDERVTKEDVKRALEEQYGGEEELPQNNPGFNNPPFKFTKYSNAYMLVYIRESDKDKIICNVDEKDIAEHLRVRLKKEQEEKEDKRKYKAQAHLFTTIKVARDDDITEQIGKNIYFDLVDHEKVRSFRIQKQTPFQQFKEEVAKEFGVPVQLQRFWIWAKRQNHTYRPNRPLLPNEELQTVGQIREASNKANNAELKLFLEIERGPDDLPIPPPEKSSEDILLFFKLYDPENAVLRYVGRLMVKSSSKPMDIVGQLNKMAGFAPDEEIDLFEEIKFEPCVMCEQLDKKTSFRLCQIEDGDIICYQKPLSIQESECRYPDVPSFLEYVQNRELVRFRTLEKPKEDEFTMELSKQHTYDDVVERVAEKLGLDDPSKLRLTSHNCYSQQPKPQPIKYRGVDHLSDMLVHYNQTSDILYYEVLDIPLPELQGLKTLKVAFHSATKDEVIIHNIRLPKQSTVGDVINELKTKVELSHQDAELRLLEVFFHKIYKIFPSTERIENINDQYWTLRAEEIPDEEKNIGPNDRLIHVYHFTKEAGQNQQVQNFGEPFFLVIHEGETLEEIKTRIQKKLHVPDEDFAKWKFASFSLGRPDYLQDTDVVYNRFQRRDVYGAWEQYLGLEHIDNAPKRAYAANQNRHAYEKPVKIYN

SEQ ID NO: 4417 - protein, 1116 aa, Solanum phureja
MTLMTPPPVEPEDEEMLVPNSDFPVEGPQPMEVATADTASTVEGPQVDDPPSGRFAWTIENFSRLNVKKLYSEVFNVGGYKWRILIFPKGNNADQLSLYLDVADSPSLPYGWSRYAHFSLGVLNQAHTKFTVRKDTQHQFNARESDWGFTSFMPLSELYDPSRGFIMDDTVVVEADVSVRKVADYWSHDSKKETGCVGLKNQGATCYMNSLLQTLYHISYFRKAVYHMPTTENDNPSGSIPLALQSLFYKLQYSDTSVATKELTKSFGWDSNDSFMQHDVQELNRVLCEKLEDKMKGTVVEGTIQQLFEGHHMNYIECINVDYRSTRKESFYDLQLDVKGCRDVYASFDKYVEVERLEGDNKYHAEKYGLQDARKGVLFVDFPPVLQLQLKRFEYDFARDTMVKINDRYEFPLQLDLDRENGKYLSPDADRSVRNLYTLHSVLVHSGGVHGGHYYAYIRPTLSDQWFKFDDERVTKEDPKRALEEQYGGEEELPHANPAFNNSPFKFTKYSNAYMLVYIRESDKEKIICNVDEKDIAEHLRVRLKKEQDEKEQKRKEKAEAHLYTIIKVARDEDLGEQIGKEIYFDLLDHDKVRSFRIQKQMVFTQFKEEVAKVLGIPVQFQRYWLWAKRQNHTYRPNRPLTPQEEVQSVGQLREVSNKTTNAELKLYLEVEIGLDLQPCPPPEKTKEDILLFFKLYDPLKEEIRYVGRLFVKGSGKPLDIMTKLNELAGISPDEEIELFEEIKFEPNVMCEPIDCNLTFCSSQLEDGDIICFQKPVRSQTSEQYRFPDVPSFLEYVHNRQVVHFRSLDKPKEEDFSLELSKLNNYDEVVESLARHLRLDDPSKIRLTSHNCYSQQPKPQPIKYRGVDRLTEMLVHYNQTSDILYYEVLDIPLPELQCLKTLKVAFYNAAKYEVTIHTIRLPKQSTVDDVLNHLKTKVELSRPDAELRLLEVFYHKIYKIFPPTERIENINDQYWTLRAEEIPEEEKNLGPLDRLIHVYHFTKDTTQNQAHVQNFGEPFFLVIHEGETLAEVKARIQRKLQVPDEEFSKWMFAFVSMGRPDYLRDSDIVSIRFQRRDVYGAWEQYLGLEHADNGPKRSYASNQNRPAFDKPVRIYN

SEQ ID NO: 4418 - protein, 1115 aa, Eutrema halophilum
MTMMTPPPLDQQEDEEMLVPHSDLVEGPQPMEVAQAEPAATSVENPPAEEPPTLKFTWTIPGFTRLNTRKHYSDIFVVGGYKWRILIFPKGNNVDHLSMYLDVADAANLPYGWSRYSQFSLAVVNQINSRYSIRKETQHQFNARESDWGFTSFMPLSELYDPTRGYLVNDTVLIEAEVAVRKVLDYWSYDSKKETGFVGLKNQGATCYMNSLLQTLYHIPYFRKAVYHMPTTENDAPTASIPLALQSLFYKLQYNDTSVATKELTKSFGWDTYDSFMQHDVQELNRVLCEKLEDKMKGTVVEGTIQKLFEGHHMNYIECINVDYKSTRKESFYDLQLDVKGCKDVYASFDKYVEVERLEGDNKYHAEGHDLQDAKKGVLFIDFPPVLQLQLKRFEYDFMRDTMVKINDRYEFPLQLDLDRENGKYLSPDADKSVRNLYTLHSVLVHSGGVHGGHYYAFIRPTLSDQWYKFDDERVTKEDVKRALEEQYGGEEELPQNNPGFNNPPFKFTKYSNAYMLVYIRESDKDKIICNVDEKDIAEHLRVRLKKEQEEKEDKRKYKAQAHLFTTIKVARDEDISEQIGKNIYFDLVDHEKVRSFRIQKQTPFQQFKEEVAKEFGVPVQLQRFWIWAKRQNHTYRPNRPLLPHEELQTVGQIREASNKANNAELKLFLEIERGPDERPIPSPEKSSEDILLFFKLYDPENAVIRYVGRLMVKSSSKPMDIVGQLNQMAGFAPDEEIELFEEIKFEPCVMCEHLDKNTTFRQCQIEDGDIICYQKPLPNQESECPYPDVPSFLEYVQNREVVRFRTLERPKDDEFTMELSKLHTYDDVVERLAEKLRLDDPSKIRLTSHNCYSQQPKPQPIKYRGVDRLSDMLAHYNQTSDILYYEVLDIPLPELQGLKTLKVAFHHATKDEVVIHNIRLPKQSTVGDVINELKTKVELSHQDAELRLLEVFFHKIYKIFPSTERIENINDQYWTLRAEEVPEEEKNIGPNDRLIHVYHFTKESGQNQQVQNFGEPFFLVIHEGETLEEIKTRIQKKLHVPDEDFAKWKFASFSMGRPDYLQDTDVVYNRFQRRDVYGAWEQYLGLEHIDNAPKRAYAANQNRHTFEKPVKIYN

SEQ ID NO: 4419 - protein, 991 aa, Populus trichocarpa
MTMMTPSPLDQEDEEMLVPHSDLVEGPQPMEVAQVEQTSTVENQPVEDPPSMKFTWTIENFTRLNTKKHYSDIFIVGSYKWRVLIFPKGNNVDHLSMYLDVADSTALPYGWSRYAQFSLAVVNQIHNKYSIRKDTQHQFNARESDWGFTSFMPLSELYDPSRGYLVNDTVVIEAEVAVCKVLDYWSYDSKKETGYVGLKNQGATCYMNSLLQTLYHISYFRKAVYHMPTTENDMPTGSIPLALQSLFFKLQYNDTSVATKELTKSFGWDTYDSFMQHDVQELNRVLCEKLEDKMKGTVVEGTIQQLFEGHHMNYIECINVEYKSTRKESFYDLQLDVKGCRDVYASFDKYVEVERLEGDNKYHAEEHGLQDAKKGVLFIDFPPVLQLQLKRFEYDFMRDTMVKINDRYEFPLQLDLDRENGKYLSPESDRSVRNLYTLHSVLVHSGGVHGGHYYAFIRPTLSDQWFKFDDERVTKEDVKRALEEQYGGEEELPQTNPGFNNTPFKFTKYSNAYMLVYIRESDKDKIICNVDEKDIAEHLRIRLKKEQEEKEDKRRYKAQAHLYTIIKVARDEDLKEQIGKDIYFDLVDHDKVRNFRIQKQTQFSLFKEEVAKELGIPVQFQRFWIWAKRQNHTYRPNRPLTPQEEAQSVGQLREVSNKTHNAELKLFLEVELGLDLRPIAPPEKTKEDILLFVKLYDPEKQELRYVGRLFVKNSSKPIEILAKLNQMAGFASEEEIELYEEIKFEPCVMCEHLDKRASFRTSQIEDGDIICFQKSPPENEEDCRNPDVPSYLEYVHNRQIVHFRSLEKAKEDDFCLELSKLHTYDDVVERVARQIGLDDPSKIRLTSHNCYSQQPKPQPIKYRGVEHLSDMLVHYNQTSDILYYEVLDIPLPELQGLKNLKVAFHHATKDEVVIHNIRLPKQSTVGDVINELKTKVELSHPNAELRLLEVFYHKIYKIFPPNEKIENINDQYWTLRAEEASQQTESLLSVD

SEQ ID NO: 4420 - protein, 1115 aa, Arabidopsis thaliana
MTMMTPPPLDQQEDEEMLVPNPDLVEGPQPMEVAQTDPAATAVENPPPEDPPSLKFTWTIPMFTRLNTRKHYSDVFVVGGYKWRILIFPKGNNVDHLSMYLDVADAANLPYGWSRYSQFSLAVVNQVNNRYSIRKETQHQFNARESDWGFTSFMPLSELYEPTRGYLVNDTVLIEAEVAVRKVLDYWSYDSKKETGFVGLKNQGATCYMNSLLQTLYHIPYFRKAVYHMPTTENDAPTASIPLALQSLFYKLQYNDTSVATKELTKSFGWDTYDSFMQHDVQELNRVLCEKLEDKMKGTVVEGTIQKLFEGHHMNYIECINVDYKSTRKESFYDLQLDVKGCKDVYASFDKYVEVERLEGDNKYHAEGHDLQDAKKGVLFIDFPPVLQLQLKRFEYDFMRDTMVKINDRYEFPLQLDLDREDGRYLSPDADKSVRNLYTLHSVLVHSGGVHGGHYYAFIRPTLSDQWYKFDDERVTKEDVKRALEEQYGGEEELPQNNPGFNNPPFKFTKYSNAYMLVYIRESDKDKIICNVDEKDIAEHLRVRLKKEQEEKEDKRKYKAQAHLFTTIKVARDDDITEQIGKNIYFDLVDHEKVRSFRIQKQTPFQQFKEEVAKEFGVPVQLQRFWIWAKRQNHTYRPNRPLSPNEELQTVGQIREASNKANNAELKLFLEIERGPDDLPIPPPEKTSEDILLFFKLYDPENAVLRYVGRLMVKSSSKPMDIVGQLNKMAGFAPDEEIELFEEIKFEPCVMCEQIDKKTSFRLCQIEDGDIICYQKPLSIEESEFRYPDVPSFLEYVQNRELVRFRTLEKPKEDEFTMELSKLHTYDDVVERVAEKLGLDDPSKLRLTSHNCYSQQPKPQPIKYRGVDHLSDMLVHYNQTSDILYYEVLDIPLPELQGLKTLKVAFHSATKDEVIIHNIRLPKQSTVGDVINELKTKVELSHQDAELRLLEVFFHKIYKIFPSTERIENINDQYWTLRAEEIPEEEKNIGPNDRLIHVYHFTKEAGQNQQVQNFGEPFFLVIHEGETLEEIKTRIQKKLHVPDEDFAKWKFASFSMGRPDYLLDTDVVYNRFQRRDVYGAWEQYLGLEHIDNAPKRAYAANQNRHAYEKPVKIYN

SEQ ID NO: 4421 - protein, 818 aa, Ambrosia trifida
MTLVTPQPLDQEEDEEMLVPHSEVLEGPRPVQGPVAFDGTPPVEAPQPMEVVGQPEGASTVDNQAIEEPQVSRFTWAIENFSRLTNKKLYSDVFVVGGYKWRVLIFPKGNNVDHLSMYLDVADSSSLPYGWSRYAQFSLAIVNQIHSKFTVKKDTQHQFHARESDWGFTSFMPLSELYDPGRGYLLNDTCIIEADVAVRKVIDYWTYDSKKETGYVGLKNQGATCYMNSLLQTLYHIPYFRKAVYHMPTTENDMPSGSIPLALQSLFYKLQYNETSVATKELTKSFGWDTYDSFLQHDVQELNRVLCEKLEDKMKGTVVEGTIQKLFEGHHMNYIECVNVDFKSTRKESFYDLQLDVKGCRDVYASFDKYVEVERLEGDNKYHAEAHGLQDAKKGVLFIDFPPVLQLQLKRFEYDFTRDMMVKINDRYEFPLELDLDRENGKYLSPDADKSVRNLYTLHSVLVHSGGVHGGHYYAFIRPTLSDNWFKFDDERVTKEDIKRALEEQYGGEEELPQTNPGYNNAPFKFTKYSNAYMLVYIRESDKDKIICDVDEKDIAEHLRIRLKKEQEEKENKRKYKAQAHLYTIIKVARDTDLLEQIGKDTFFDLVDHDKVHSFRIQKQTPFNQFKDEVAKEFGVPVQFQRFWIWAKRQNHTYRPNRPLTALEETQSVGQLREVSSKNQNAELKLFLEIEIGPDLHPIPPPDKSKEDILLFFKLYDPEKEELRYVGRFFVKSSGKPTEIITKLNERAGFSLDEEIELYEEIKFEPCVMCERLDKRTSFRSSQIEDGDIICFQKLPKAEDKYRYPDVPSFLEYVKIVR

SEQ ID NO: 4422 - protein, 1122 aa, Solanum lycopersicum
MTMLNPQPLDQQEDEEMLVPHSELVEGPQPLVEGPQPMEVAASENATTGENQAVDEPQASRFTWTIDEFSRLSVKKLYSEPFVVGSYKWRVLIFPKGNNVECLSMYLDVADSATLPYGWNRYAQFSLTVVNQINPKYSVKKETQHQFNQRESDWGFTSFMLLSDLYDPNKGYLVNDKVVIEADVAVRKVIDYWTYDSKKETGYVGLKNQGATCYMNSLLQTLYHIPYFRKAVYHMPTTENDMPSGSIPLALQSLFYKLQYSDTSVATKELTKSFGWDTYDSFMQHDVQELNRVLCEKLEDKMKGTVVEGTIQKLFEGHHMNYIECINVDFKSTRKESFYDLQLDVKGCRDVYASFDKYVEVERLEGDNKYHAEAHGLQDAKKGVLFIDFPPVLQLQLKRFEYDFMRDTMVKINDRYEFPLELDLDRENGKYLSPDADRSVRNLYTLHSVLVHSGGVHGGHYYAFIRPTLSDQWYKFDDERVTKEDNKRALEEQYGGEEELPQTNPGFNNTPFKFTKYSNAYMLVYIRESDKDKIICDVGEKDIAEHLRIRLKKEQEEKEDKRRYKAQAHLYTIIKVARDEDLREQIGKEIYFDLVDHDKVRSFRIQKQLPFNLFKEEVAKELGIPVQFQRFWIWAKRQNHTYRPNRPLTPHEELQTVCQLREVSNKNNNAELKLFLEVDYGLDFIPGPPPDKSKDDILLFFKLYDPEKEELRYVGRLFVKSTSKPVEILPKLNELAGFAPDQEIELFEEIKFEPSVMCERLDRKASFRFSQIEDGDIICFQKKTSPEVEEQVRFPDVPSYMEYVKNRQLVHFRALEKPKEDDFCLELAKSDTYDEVVDRVAQRLGVDDSSKIRLTPHNCYSQQPKPNPIKYRSVDHLVDMLIHYNQISDILYYEVLDIPLPELQCLKTLKVAFHHSTKDEIEILNVRLPKQSTVGDVLEEIKSKVELSHPNAELRLLEVFYHKIYKIFPLSEKIENINDQYWTLRAEEIPEEEKNLGPHDRLIHVYHFTKETPQNQMQVQNFGEPFFLVIHEGETLAEIKVRIQKKLQVSDEEFSKWKFAFLSLGRPEYLQDSDIVSNRFQRRDVYGAWEQYLGLEHADNTSKRPYINQNRHTFEKPVKIYN

SEQ ID NO: 4423 - protein, 1117 aa, Solanum lycopersicum
MTLMTPPPVEQPEDEEMLVPNSDFPVEGPQPMEVATADTASTVEGPQVDDPPSGRFAWTIEKFSRLNVKKLYSEVFNVGGYKWRILIFPKGNNADQLSLYLDVADSPSLPYGWSRYAHFSLGVLNQAHTKFTVRKDTQHQFNARESDWGFTSFMPLSELYDPSRGFIMDDTVIVEADVSVRKVADYWSHDSKKETGCVGLKNQGATCYMNSLLQTLYHISYFRKAVYHMPTTENDNPSGSIPLALQSLFYKLQYSDTSVATKELTKSFGWDSNDSFTQHDVQELNRVLCEKLEDKMKGTVVEGTIQQLFEGHHMNYIECINVDYRSTRKESFYDLQLDVKGCRDIYASFDKYVEVERLEGDNKYHAEKYGLQDARKGVLFVDFPPVLQLQLKRFEYDFARDTMVKINDRYEFPLQLDLDRENGKYLSPDADRSVRNLYTLHSVLVHSGGVHGGHYYAYIRPTLSDQWFKFDDERVTKEDPKRALEEQYGGEEELPHTNPAFNNSPFKFTKYSNAYMLVYIRESDKEKIICNVDEKDIAEHLRVRLKKEQDEKEQKRKEKAEAHLYTIIKVARDEDLGEQIGKEIYFDLLDHDKVRSFRIQKQMVFTQFKEEVAKVLGIPVQFQRYWLWAKRQNHTYRPNRPLTPQEEVQSVGQLREVSNKTSNAELKLYLEVEVGLDLQPCPPPEKTKEDILLFFKLYDPLKEEIRYVGRLFVKGSGKPLDILSKLNELAGFSPDEEIELFEEIKFEPNVMCEPIDCNLTFCSSQLEDGDIICFQKPVQSQTSEQCRFSDVPSFLEYVHNRQVVHFRSLEKPKEEDFSLELSKLNTYDEVVESLARHLRLDDPSKIRLTSHNCYSQQPKPQPIKYRGVDRLTEMLVHYNQTSDILYYEVLDIPLPELQCLKTLKVAFYNAAKYEVTIHTIRLPKQSTVDDVLNHLKTKVELSRPDAELRLLEVFYHKIYKIFPPTERIENINDQYWTLRAEEIPEEEKNLGPLDRLIHVYHFTKDTTQNQAHVQNFGEPFFLVIHEGETLAEVKVRIQRKLQVPHEEFSKWAFAFVSMGRPDYLRDSDIVSIRFQRRDVYGAWEQYLGLEHADNGPKRSYASNQNRPTFDKPVRIYN

SEQ ID NO: 4424 - protein, 897 aa, Valeriana officinalis
MYLDVADAPTQPYGWSRYAQFSLGVVNQIHTKFTVRKDTQHQFNARESDWGFTSFMPLGELYDLSRGYIVNDTCIIEADVAVRKVVDYWSHDSKKETGYVGLKNQGATCYMNSLLQTLYHIPYFRKAVYHMPTTENDMPSGSIPLALQSLFYKLQYSDSSVATKELTKSFGWDSYESFMQHDVQELNRVLCEKLEDKMKGTVVEGTIQQLFEGHHMNYIECINVDYKSTRKESYYDLQLDVKGCRDVYASFDKYVEVERLEGDNRYHAEQHGLQDARKGVLFIDFPPVLQLQLKRFEYDFMRDTMVKINDRYEFPLELDLDRENGKYLSPDADRRVRNLYTLHSVLVHSGGVHGGHYYAYIRPTLSEKWFKFDDERVTKEDMKRAMEEQYGGEEELPQANPGFTNSPFKFTKYSNAYMLVYIRETDKDKIICNVDEKDIAEHLRIRLKKEQEEKEQKRKEKAEAHLYTIIKVARDEDLFEQIGRELYFDLIDHDKVRSFRIQKQTPFNVFKEEVAKALGIAVEHQRFWLWAKRQNHTYRPNRPLTPQEEAQSVGQLREVSNKASNAELKLFLEVEVGVNLQPILPPEKTKDDILLFFKIYDPLKEELRYVGRVFVKASSKPVENLAKLNELAGFDPDEEIDLYEEIKFEPNIMCERVDKNIPFRSNQLEDGDIICLQKTVSAETSEEFRYPDVPSFLEYVHNRQVVRFRSLEKPKEDEFSLELSKLHSYDDVVERVAQHLNLDDPSKLRLTSHNCYSQQPKPQPIKYRGVEHLSAMLVHYNQTSDILYYEILDIPLPELQGLKTLKVAFHHATKDEVVIHTIRLPKQSTVGDVINDLKTKVELSHPSAELRLLEVFITKSTRFSPSMKRLRTLMISTGHYAQKRFRKRRRALVLRIG

SEQ ID NO: 4425 - protein, 1123 aa, Olea europaea
MTMMAPQSLDQQEDEEMLVPHSNLVEGPQPLVESPQPMEVASTNNAGATENQASDEPQASRFTWTIENFSRLNVKKLYSEVFVVGGYKWRVLIFPKGNNVEYLSMYLDVANSANLPYGWTRYAQFSLAVVNQIHSKYTVKKDTQHQFSQRESDWGFTSFMPLSELYDPSKGYIVNDTCVVEADVAVRKVIDYLTYDSKKETGFVGLKNQGATCYMNSLLQTLYHIPYFRKAVYHMPTTENDMPSGSIPLALQSLFYKLQYNDTSVATKELTKSFGWDTYDSFMQHDVQELNRVLCEKLEDKMKGTVVEGTIQKLFEGHHMNYIECINVDFKSTRKESFYDLQLDVKGCKDVYASFDKYVEVERLEGDNKYHSEEHGLQDSKKGVLFIDFPPVLQLQLKRFEYDFMRDIMVKINDRYEFPLELDLDRDNGKYLSPDADRSVRNLYMLHSVLVHSGGVHGGHYYAFIRPTLSEQWYKFDDERVTKEDTKRALEEQYGGEEELPQTNPGFYNTPFKFTKYSNAYMLVYIRVSDKDKIICDVDEKDIAEHLRIRLKKEQEQKEDKRRYKAQAHLYTNIKVARDVDLREQIGKDIFFDLVDHDKVHSFRIQKQIPFNLFKEEVAKEFGIPVQFQRFWIWAKRQNHTYRPNRPLNPQEEAQTVGALREVSNKAHNADLKLFLEIEFGQDLHPIPPPDKSKEDILLFFKLYDPEKEELRYVGRLFVKGSSKPIEILTKLNELAGFASDEEIELFEEIKFEPSVMCERLDIRASFRFSQIEDGDIICFQKRPVPEGEEKFRFPDVASFLEYVKNRQIVHFRALERPKEDEFCLELAKNHTYDDVVERLAQRLGLDDPSKIRLTPHNCYSQQPKPTSIKYRSVDQLVDMLVHYNQISDILYYEVLDIPLPQLQCLKTLKVAFHNATKDEAVVLNIRLPKQGTVGDVLNVIKEKVELSHPNAELRLLEVFHHKIYKIFPLYEKIENINDQYWTLRAEEIPEEEKNLGPNDRLIHVYHFTKENAQNQVQIQNFGEPFFLVIHEGETLSHVKLRVQKKLLVPDEEFSKWKFAALSLGRPEYLEDSDIVSSRFQRRDVYGAWEQYLGLEHSDTTPKRAYTANQNRHTFEKPVKIYN

SEQ ID NO: 4426 - protein, 1115 aa, Eutrema parvulum
MTMMTPPPLDQQEDEEMLVPHSDLVEGPQPMEVAQPEAAATTVENPPAEEPPTLKFTWPIPCFTRLNTRKHYSDIFVVGGYKWRILIFPKGNNVDHLSMYLDVADAANLPYGWSRYSQFSLAVANQISSRYSVRKETQHQFNARESDWGFTSFMPLSELYDPTRGYLVNDTVLIEAEVAVRKVLDYWSYDSKKETGFVGLKNQGATCYMNSLLQTLYHIPYFRKAVYHMPTTENDAPTASIPLALQSLFYKLQYNDTSVATKELTKSFGWDTYDSFMQHDVQELNRVLCEKLEDKMKGTVVEGTIQKLFEGHHMNYIECINVDYKSTRKESFYDLQLDVKGCKDVYASFDKYVEVERLEGDNKYHAEGHDLQDAKKGVLFIDFPPVLQLQLKRFEYDFMRDTMVKINDRYEFPLQLDLDRENGRYLSPDADKSVRNLYTLHSVLVHSGGVHGGHYYAFIRPTLSDQWYKFDDERVTKEDVKRALEEQYGGEEELPQNNPGFNNPPFKFTKYSNAYMLVYIRESDKDKIICNVDEKDIAEHLRVRLKKEQEEKEDKRKYKAQAHLFTTIKVARDEDITEQIGKNIYFDLVDHEKVRSFRIQKQTPFLQFKEEVAKEFGVPVQLQRFWIWAKRQNHTYRPNRPLLPHEELQTVGQIREASNKASNAELKLFLETERGSDERPIPPPDKSSEDILLFFKLYDPENAILRYVGRLMVKSSSKPMDIVGQLNQMAGFAPDEEIELFEEIKFEPCVMCEHLDKNSSFRLCQIEDGDIICYQKPLSIQENECPYPDVPSFLEYVQNREVVRFRTLEKPKEDEFTMELSKLHTYDDVVERLAEKLGLDDPSKIRLTSHNCYSQQPKPQPIKYRGVDHLSDMLAHYNQTSDILYYEVLDIPLPELQGLKTLKVAFHHATKDEVVIHNIRLPKQSTVGDVINELKTKVELSHQDAELRLLEVFFHKIYKIFPSTERIENINDQYWTLRAEEIPEEEKNIGASDRLIHVYHFTKEAGQNQQVQNFGEPFFLVIHEGETLEEIKTRIQKKLHVPDEDFAKWKFASFSMGRPDYLQDTDVVYNRFQRRDVYGAWEQYLGLEHVDNAPKRAYAANQNRHAYEKPVKIYN

SEQ ID NO: 4427 - protein, 1090 aa, Nicotiana benthamiana
MLVPNSDFPVEGPQSMEVATADTASTVDGPPVDDPPSARFTWTVENFSRLNTKKLYSDVFHVGGYKWRILVFPKGNNVDHLSMYLDVADSPALPYGWSRHAQFSLAVLNRVHNKFTVRKDTQHQFNARESDWGFTSFMPLSELYDPVRGYLVDDTVIVEADVAVRRVIDYWSHDSKKETGCVGLKNQGATCYMNSLLQTLYHIPYFRKAVYHMPTTENDNPSGSIPLALQSLFYKLQYSDTSVATKELTKSFGWDTYDSFMQHDVQELNRVLCEKLEDKMKGTVVEGTIQQLFEGHHMNYIECINVDYKSTRKESFYDLQLDVKGCRDVYASFDKYVEVERLEGDNKYHAEKYGLQDARKGVLFIDFPPVLQLQLKRFEYDFVRDTMVKINDRYEFPLELDLDRENGKYLSPDADRSVRNLYTLHSVLVHSGGVHGGHYYAYIRPTLSDQWFKFDDERVTKEDSKRALEEQYGGEEELPHANPGFNNSPFKFTKYSNAYMLVYIRESDKEKIICNVDEKDIAEHLRVRLKKEQDEKEQKRKEKAEAHLYTIIKVARDEDLGEQIGKEIYFDLVDHDKVRSFRIQKQMAFTQFKEEVAKELGIPVQFQRYWLWAKRQNHTYRPNRPLTPQEEAQSVGQLREVSNKANNAELKLFLEVEFGLDLRPCPPPEKTKEDILLFFKLYDPLKEEMRYAGRLFVKGSGKPLEILPKLNELSGFSPDEDIELFEEIKFDPNVMCEPIDWKLTFRGSQLEDGDIICFQKPLRSQTSEQYRFPDVPSFLEYVHNRQVVRFRSLEKSKEDDFSLELSKQNNYDEVVERLARHLGLDDPSKIRLTSHNCYSQQPKPQPIKYQGVDHLTEMLVHYNQTSDILYYEVLDIPLPELQCLKTLKVAFYNSAKDEVTIHTIRLPKQSTVDDVLNHLKTKVELSHPDAELRLLEVFYHKIYKIFPPTERIENINDQYWTLRAEEIPEEEKNLGPHDRLIHVYHFMKDTTQNQSHVQNFGEPFFLVIHEGETLTEVKARIQKKLQVPDEEFSKWKFAFLSMGRPDYLQDSDVVSNRFQRRDVYGAWEQYLGLEHADNAPKRSYASNQVC

SEQ ID NO: 4428 - protein, 1113 aa, Eucalyptus grandis
MTMMTPPPLDQEEEEMLVPHSDLVVEGPQPMEGVAQVDPAGAVETQQLEEPPSMKFTWRIDNFPRLNVRKHYSEVFVVGGYKWRILIFPKGNNVEHLSMYLDVADSPALPYGWSRYAQFSLAVVNQSNNKYTIRKDTQHQFNVRESDWGFTSFMPLGELYDPVRGYMVNDTVFVEAEVVVRKILDYWSYDSKKETGYVGLKNQGATCYMNSLLQTLYHIPYFRKAVYHMPTTENDMPSGSIPLALQSLFYKLQYHDSSVTTKELTRSFGWDTYDSFMQHDVQELNRVLSEKLEDKMKGTVVEGTIQQLFEGHHMNYIECIDVDYKSTRKESFYDLQLDVKGCRDVYASFDKYVEVERLEGDNKYQAEEHGLQDAKKGVLFIDFPPVLQLHLKRFEYDFIRDTMVKINDRYEFPLQLDLDRDNGKYLSPDADRSVRNLYSLHSVLVHSGGVHGGHYYAFIRPTLSDLWFKFDDERVTKEDIKRALEEQYGGEEELPQTNPGFNNTPFKFTKYSNAYMLVYIRDSDKDKIICHVDEKDIAEHLRVRLKKEQEEKEEKRKHKAQAHLYTIIKVAREEDLVEQIGKDIYFDLVDHDKVRSFRIQKQIKFKDFKEEVARDFGVPVQCQRFWLWAKRQNHTYRPNRPLAPPEEEQPVGQLREMMNKTNNAELKLFLEVELGLDKVPVSPPEKSKDDILLFFKLYNPEKGELRYVGRLFVKFYGRPIEILPRLIEMAGFNQDEELELFEEIKFVPGVMCEHLDKKISFRASQLEDGDIICFQKARMDNEDEFRYPDVPSYLEYVHNRQIVHFRSLERPKEDDFVLELSKVHNYDEVVERVAQQVGLDDPSKIRLTSHNCYSQQPKPQPMKFQGVEHLSDMLVHYNQTSDILYYEVLDIPLPELQGLKNLKVAFHHASKDEVVIHHIRLPKQSTVGDVINELKTKVDLSRPDAELRLLEVFYHKIYKIFPSSEKIENINDQYWTLRAEEIPEEEKDLGPHDRLIHVYHFMKETAQSQLQVQNFGEPFLLLIHEGETLAEVKMRIQKKLQVPDDAFSKWKFAFLSLGRPEYLEDSEILSNRFQRRDVYGEQYLGLEHSDAPKRSYVVNQNRHTHEKPVKIYN

SEQ ID NO: 4429 - protein, 1092 aa, Eutrema parvulum
MTMMTPPPVDQQEDEEMLVPHSDLVDGPTQPMEVSQTETAASTVENQPAEDPPTLKFTWTIQNFSRQNTRKHYSDVFVVGGYKWRILIFPKGNNVDHLSMYLDVSDAASLPYGWSRYAQFSLAVVNQIHTRYTIRKETQHQFNARESDWGFTSFMPLSELYDPSRGYLVNDTVYIEAEVAVRKVLDYWSYDSKKETGFVGLKNQGATCYMNSLLQTLYHIPYFRKAVYHMPTTENDAPTASIPLALQSLFYKLQYNDTSVATKELTKSFGWDTYDSFMQHDVQELNRVLCEKLEDKMKGTVVEGTIQQLFEGHHMNYIECINVDYKSTRKESFYDLQLDVKGCKDVYASFDKYVEVERLEGDNKYHAEGHGLQDAKKGVLFIDFPPVLQLQLKRFEYDFMRDTMVKINDRYEFPLQLDLDRENGKYLSPDADRSVRNLYTLHSVLVHSGGVRVTKEDLKRALEEQYGGEEELPQTNPGFNNPPFKFTKYSNAYMLVYIRESDKDKIICNVDEKDIAEHLRVRLKKEQEEKEDKRRYKAQAHLFTIIKVARDQDLKEQIGKDIYFDLVDHDKVRSFRIQKQTPFQQFKEEVAKEFGVPVQLQRFWIWAKRQNHTYRPNRPLTPQEELQPVGQIREASNKANTAELKLFLEVELLDERPIPPPEKSKEDILLFFKLYDPEKPELRYVGRLMVKSSSKPMDITGKLNEMAGFAPDEEIELFEEIKFDPCVMCEHLDKKTSFRLCQIEDGDIICFQKPLGNKEVECRYPAVPSFLEYVQNRQLVRFRALERPKEDEFVLELSKLHTYDDVVERVAQKLGLDDPSKLRLTSHNCYSQQPKPQPIKYRGVDHLSDMLVHYNQTSDILYYEVLDIPLPELQGLKTLKVAFHHATKEEVVIHNIRLPKQSTVGDVINELKTKVELSHPDAELRLLEVFYHKIYKIFPSTERIENINDQYWTLRAEEIPEEEKNIGPNDRLILVYHFAKETGQNQQVQNFGEPFFLVIHEGETLEEIKNRIQKKLHVSDEDFAKWKFAFMSMGRPEYLQDSDVVYNRFQRRDVYGAFEQYLGLEHTDTSPKRAYAANQNRHTYEKPVKIYN

SEQ ID NO: 4430 - protein, 1047 aa, Papaver somniferum
HYSDVFTVGAYKWRVLIFPKGNNVDHLSMYLDVADSANLPYGWSRYAQFSLAIVNQIHNKYTVRKDTQHQFTARESDWGFTSFMPLSELYDPGRGYLVNDTCIVEAEVAVRKITDYWTYDSRKETGYVGLKNQGATCYMNSLLQTLYHIPYFRKAVYHMPTTENDLPSGSIPLALQSLFYKLQYSDNSVATKELTKSFGWDTYDSFMQHDVQELNRVLCEKLEDKMKGTVVEGTIQQLFEGHHMNYIECINVDYKSTRKESFYDLQLDVKGCRDVYASFDKYVEVERLEGDNKYHAEQHGLQDAKKGVLFIDFPPVLQLQLKRFEYDFMRDTMVKINDRYEFPLQLDLDREDGKYLSPDADRRVRNLYTLHGVLVHSGGVHGGHYYAFIRPTLSEQWFKFDDERVTKEDIKRALEEQYGGEEELPQTNPGFNNTPFKFTKYSNAYMLVYIRESDKDKIICNVDEKDIAEHLRIRLKKEQEEKEHKKKEKAEAHLYTIIKVARNEDLFEQIGRDIYFDLVDHDKVRSFRIQKQMPFNLFKEEVAKEFGVPVQFQRFWLWAKRQNHTYRPNRPLTPQEETQSVGQLREVSNKAHNAELKLFLEIELGPESHPIPPPDRTKEDILLFFKLYDAEKEELRYVGRLFVKGSGKPLEILKKLNEMAGFSPDEEIELYEEIKFEPTVMCEHIDKKLTFRASQLEDGDIICFQKPTSADSMTLCRYPDVPTFLEYVHNRQVVHFRSLEKPKEDDFCLELSKVLTYDDVTERVARHLGLDDPTKIRLTPHNCYSQQPKPQAIKYQGVDHLSEMLVHYNQTSDILYYEVLDIPLPELQGLKTLKVAFHHATKEDTVVHSIRLPKQSTVGDVINDLKTKVELSHPDAELRLLEVFYHKIYKIFPLSEKIENINDQYWTLRAEEIPEEEKNLGPQDRLIHVYHFTKDASQTQMQVQNFGEPFFLIIHEGETLGAVKLRIQKKLQIPDEEFAKWKFAFLSLGRPEYLQDSDVVSSRFQRRDVYGAWEQYLGLEHSDSSPKRAYAANQNRHTFEKPVKIYN

SEQ ID NO: 4431 - protein, 1017 aa, Ambrosia trifida
MYLDVADSSSLPYGWSRYAQFNLAVINQIDSKFTVKKDTQHQFHARESDWGFTSFMPLSDLYDPSRGFLINDTCIIEADVAVRKVIDYWTYDSKKETGYVGLKNQGATCYMNSLLQTLYHIPYFRKAVYHMPTTENDIPTGSIPLALQSLFYKLQYNETSVATKELTKSFGWDTYDSFMQHDVQELNRVLCEKLEDKMKGTVVEGTIQKLFEGHHMNYIECVNVDFKSTRKESFYDLQLDVKGCRDVYASFDKYVEVERLEGDNKYHAEAHGLQDAKKGVLFIDFPPVLQLQLKRFEYDFTRDTMVKINDRYEFPLELDLDRENGKYLSPDADKSVRNLYTLHSVLVHSGGVHGGHYYAFIRPTLSDQWFKFDDERVTKEDMKRALEEQYGGEEELPQTNPGYNNAPFKFTKYSNAYMLVYIRENDKDKIICDVDEKDIAEHLRIRLKKEQEEKEDKRRYKAQAHLYTIIKVARDADLLEQIGKDIYFDLVDHDKVHNFRIQKQTPFNQFKEEVAKQFGVPVQFQRFWIWAKRQNHTYRPNRPLTALEETQSVGQLREVSNKNNNAELKLFLEIEIGPDLHPLPPPDKSKEDILLFFKLYDPEKEELRYVGRFFVKSSSKPTEIILKLNERAGFSPDEEIELYEEIKFEPCVMCERLDKRSSFRSSQIEDGDIICFQKLPKAEGKCRYPDVPSFLEYVKNRQIVHFRSLDRPKEDDFCLELSKLHTYDDVVERVAQKLNLDDPSKIRLTPHNCYSQQPKPHPIKYRVAEHLLDMLVHYNQVSDILYYEVLDIPLPQLQCLKTLKVAFHHSNKEEPVIHNIRLPKQSTVGDVLNELKSKVTLSHQNAELRLLEVFYHKIYKIFPLTEKIENINDQYWTLRAEEIPEEEKNLGPQDRLIHVYHFTKEAAQNQMQVQNFGEPFFLIIHENETLADVKVRIQRKLEVPDEEFSKWKFAFLSLGRPEYLQDSDVVSSRFQRRDVYGAWEQYLGLEHSDTTPKRSFTANQNRHSFEKPVKIYN

SEQ ID NO: 4432 - protein, 1052 aa, Theobroma cacao
MKFTWTIENFSRLNTKKHYSDIFVVGGYKWRILIFPKGNNVDHLSMYLDVADSSTLPYGWSRYAQFSLAVVNQIHHKYSIRKDTQHQFNARESDWGFTSFMPLSDLYDPSRGYLVNDTVVVEAEVAVRKILDYWSYDSKKETGYVGLKNQGATCYMNSLLQTLYHIPYFRKAVYHMPTTENDMPIGSIPLALQSLFYKLQYNDTSVATKELTKSFGWDTYDSFMQHDVQELNRVLCEKLEDKMKGTVVEGTIQQLFEGHHMNYIECINVDYKSTRKESFYDLQLDVKGCRDVYASFDKYVEVERLEGDNKYHAEEHGLQDAKKGVLFIDFPPVLQLQLKRFEYDFMRDTMVKINDRYEFPLQLDLDRENGKYLSPEADRSVRNLYTLHSVLVHSGGVHGGHYYAFIRPTLSDQWYKFDDERVTKEDMKRALEEQYGGEEELPQTNPGFNNTPFKFTKYSNAYMLVYIRESDKDKIICNVDEKDIAEHLRIRLKKEQEEKEDKRRYKAEAHLYTIIKVARDEDLAEQIGRDIYFDLVDHDKVRSFRIQKQIPFHVFKEEVAKEFGIPVQYQRFWIWAKRQNHTYRPNRPLTSQEEAQSVGQLREVSNKAHNAELKLFLEVEHGQDLRTIPPPDKTREDILLFFKLYDPEKGELRYVGRLLVKLSGKPIEYIAKLNQMAGFAPDEEIELYEEIKFEPCVMCEHLDKRCSFRLSQIEDGDIICFQKSPPTESEEACRYPDVPSFLEYVHNRQIVRFRSLERPKEDDFCLELSKIHTYDDVVERVARKIGLDDPSKIRLTSHNCYSQQPKPQPIKYRGVEHLSEMLVHYNQTSDILYYEVLDIPLPELQGLKNLKVAFHHATKDEVVIHNIRLPKQSTVGNVIDELKTKVELSHPNAELRLLEVFYHKIYKVEIVFPPSEKIENINDQYWTLRAEEASIPEEEKNLGPHDRLIHVYHFTKETSQNQMQVQNFGEPFFLVIHEGETLAEVKVRIQKKLQVHDEEFTKWKFAFLSLGRPEYLQDSDIVFNRFQRRDVYGAWEQYLGLEHPDNTPKRAY

SEQ ID NO: 4433 - protein, 1052 aa, Cicer arietinum
MNTKKLYSEVFVVGSYKWRVLIFPKGNNVDYLSMYLDVADSTSLPYGWSRYAQFSLAVVNQIHNKYSVRKDTQHQFNARESDWGFTSFMPLGELYDPSRGYLMNDTLIIEAEVLVRRIVDYWTYDSKKETGYVGLKNQGATCYMNSLLQTLYHIPYFRKAVYHMPTTENDIPSGSIPLALQSLFYKLQYSDTSVATKELTKSFGWDTYDSFLQHDVQELNRVLCEKLEDKMKETVVEGTIQKLFEGHHMNYIECINVDYKSTRKESFYDLQLDVKGCPDVYASFDKYVEVERLEGDNKYHAEQYGLQDAKKGVLFIDFPPVLQLQLKRFEYDFMRDTMVKINDRYEFPLQLDLDRYNGKYLSPDADRNVRNLYTLHSVLVHSGGVHGGHYYAFIRPTLSDQWYKFDDERVTKEDPKRALEEQYGGEEELPQTNPGFNNTPFKFTKYSNAYMLVYIRDTDKEKIICNVDEKDIAEHLRERLKKEQEEKEHKKKEKAEAHLYTIIKVARDEDLEEQIGKDIYFDLVDHDKVRSFRVQKQTPFNVFKEEVAKEFGVPVQFQRFWLWAKRQNHTYRPNRPLTQIEEAQSVGQLREISNKVHNAELKLFLEVERGPDIFPIAPPEKTKDDILLFFKLYDPEKEELRYVGRLFVSSTGKPSEIIARLNKMARYDPDEEIGLYEEIKFEPNVMCEPIDKKLTFRGSQLEDGDIICFQKAPAMDIEEHIRYPDVPSYLEYVHNRQVVHFRSLDKPKEDDFCLEMSRLFTYDDVVERVAQKLGLDDPSKIRLTPHNCYSQQPKPQPIKYRGLEHLSDMLVHYNQTSDILYYEVLDIPLPELQGLKTLKVAFHHATKDEVVIHTIRLPKQSTVGDVLDDLKTKVELSRPDAELRLLEVFYHKIYKVFPPNEKIENINDQYWTLRAEEIPEEEKNLGPHDRLIHVYHFTKDTTQNQMQIQNFGEPFFLVIHECECLDEIKVRIQKKLQVPDDEFPKWKFAFFSLGRPEYLEDSDIVSSRFQRREVYGAWEQYLGLEHTDNAPKRSYAANQNRHTFEKPVKIYN

SEQ ID NO: 4434 - protein, 1101 aa, Nicotiana benthamiana
MLVPSSDFPTDGPQPMEVAPADTASTVDAQAVDDPASARFTWTIDNFSRLNVKKLYSDVFNVGGYKWRILIFPKGNNVDNLSMYLDVADSATLPYGWSRHAQFSLAILNRIHNKFTVRKDTQHQFNPRESDWGFTSFMPLSELYDPGRGYLVDDTVIVEADVAVRKVIDYWSHDSKKETGCVGLKNQGATCYMNSLLQTLYHIPYFRKAVYHMPTTENDNPSSSIPLALQSLFYKLQYSDTSVSTKELTKSFGWDTYDSFMQHDVQELNRVLCEKLEDKMKGTVVEGTIQQLLEGHHMNYIECINVDYKSTRKESFYDLQLDVKGFCDVYASFDKYVEVERLEGDNKYHAEQHGLQDARKGVLFIDFPPVLQLQLKRFEYDFARDAMIKINDRYEFPLQLDLDRENGKYLSPDADRSVRNLYTLHSVLVHSGGVHGGHYYAYIRPTLSDQWYKFDDERVTKEDTKRALEEQYGGEEELRHTNPGFNNSPFKFTKYSNAYMLVYIRESDKDKIICNVDEKDIAEHLRIRLKKEQEEKEQKRKEKAEAHLYTIIKVARDEDLGEQIGKEIYFDLLDHDKVRSFRIQKQMPFTQFKEEVAKELGIPVQFQRYWLWAKRQNHTYRPNRPLTAQEEVQSVGQLREVSNKANNAELKLFLEVEFGLDLQPFPPPEKTKEDILLFFKLYDPLKEEIRYVGRLFVKGSGKPLEILTKLNELAGFLPDEEIELFEEIKFEPNVMCEHIDWKLSFCGSQLEDGDIICFQKSLRNQDREQYRFPEVPLFLEYVHNRQVVRFRSLEKPKEDEFSLELSKKNNYDEVVEHLARHLGLDDASKVRLTSHNCYSQQPKPQPIRYRGVDRLTEMLSHYNQTSDILYYEVLDIPLPELQGLKALKVTFHLAAKDEVTIHTIRLPKQSTIGDVLNDLKTKVELTRPDAELRLLEVFYHKIYKIFPLNERIENINDQYWTLRAEEIPEEEKNLGPHSRLIHVYHFMKDTSQNQAQIHNFGDPFFLVIHEGDTLTEVKARIQKKLQVPDEEFSKWKFAFLSMGRPEYLEDSDVVSNRFQKRDVYGAWEQYLGLEHIDNAPKRSHAANQNRHTFEKPVRIYN

SEQ ID NO: 4435 - protein, 999 aa, Picea glauca
MEATVGQADTVSTAENQPIVEDPPTSKFSWTIEHLSKLNMKKHYSETFVVGGYKWRILIFPRGNNVDHLSMYLDVADSSTLPYGWSRYAHFSLAVVNQIHSKYSVRKDTQHQFNTRESDWGFTSFMPLLDLYDSGKGYLVNDTLVIEAEVTVQRGMDYLQYDSKKETGFVGLKNQGATCYMNSLLQTLYHIPYFRKAVYHMPTTENDVPSNSIPLALQSLFYKVQYNDTSVSTKDLTKSFGWDTYDSFMQHDVQELNRVLSEKLEDKMKGTAVEGTIQQLFEGHHMNYIECINVDYKSTRKESFYDLQLDVKGCRDVYASFDKYVEVEKLEGDNKYHAENYGLQEARKGVLFIDFPPVLQLQLKRFEYDFMRDTMVKINDRYEFPLQLDLDRENGKYLSPDADRSVRNLYTLHSVLVHSGGVHGGHYYAFIRPTLSDQWYKFDDERVTKEDVKRALEEQYGGEEELPQTNPGLNNTPFKFTKYSNAYMLVYVRESDKDKIICNVDEKDIAEHLRVRLKKEQEEKELKRKEKAEAHLYTIIKVARDKDLSNQIGKDIYFDLVDHDKVRTFRIQKQVPFVSFKEEVAKEFGIPVQFQRFWLWAKRQNHTYRPNRPLTQPEESQSVGYLRETSNKAHTAELRLFLEAEYSPDLQLLPPPEKTKDDILLFFKLYDPEKEELRFVGRLFVKAGGRPIEYITKLNAMAGFPADEEIDLFEEIKFEPNVMCELIEKRSPFRTSQLEDGDIICFQRSLTSEDDLHRYPDVPSFLDYVHNRQIVHFRRLDKPKEDDFCLELSKLFTYDDVVERVAQQLDLDDPSKIRLTAHNCYSQQPKPQPIRYRGVDHLSDMLVHYNQISDILYYEILDIPLPELQGLKTLKVAFHHSTKDEVSVHSIRLPKQSSVGDVINELKTKVELSNPNADIRLLEVFYHKIYKIFPLNEKIENINDQYWTLRAEEVPEEEKNLGPQDRLIHVYHFTKDASQNHMVQNFGEPFFWLSMKAKH

SEQ ID NO: 4436 - protein, 530 aa, Taxus baccata
RLSVPWKINPPKILLHLDLPGQLKTFQGLNVKKHYSDVFTVGGFKWRVLIFPKGNNVDQLSMYLDVADAATLPYGWSRQAQFSLAVVNQISSKYSIRKDTQHQFNARESDWGFTSFMPLGEIYDPSKGYLVNDSLVVEADVVVRKVDSCWQYDSKKETGFVGLKNQGATCYMNSLLQTLYHVPYFRKAVYHMPTTENDMPSGSIPLALQSLFYKLQYSDSSVATKELTKSFGWDTYDSFMQHDVQELNRVLSEKLEDKMKGTVVEGTIQQLFEGHHMNYIECINVDYKSTRKESFYDLQLDVKGCRDVYASFDKYVEVERLEGDNKYHAEQHGLQDAKKGVLFIDFPPVLQLQLKRFEYDFMRDTMVKINDRYEFPLQLDLDRESGKYLSPDADRSVRNLYTLHSVLVHSGGVHGGHYYAYIRPTLSDQWFKFDDERVTKEDMKKALEEQYGGEEELPQTNPGFNNTPFKFTKYSNAYMLVYIRESDRDKIICNVDEKDIAEHLRVRLKKEQEEKEQKEKRRPRHTFIRL

SEQ ID NO: 4437 - protein, 1076 aa, Cannabis sativa
MTLMTPPPLDQQEDDEMLVPHTDFAHGPQPMEVAQPENTNAVEAQPVDDPPSARFTWTIDNFTRLNTKKLYSDVFFVGGHKWRILIFPKGNNVDHLSMYLDVADSTALPYGWSRYAQFSLSVVNQLQSKYSVRKETQHQFNARESDWGFTSFMPLGELYDPGRGYLVNDTCIVEADVAVRRVVDYWSHDSKKETGYVGLKNQGATCYMNSLLQTLYHIPYFRKAVYHMPTTENDNPSGSIPLALQSLFYKLQYSDTSVATKELTKSFGWDTYDSFMQHDVQELNRVLCEKLEDKMKGTVVEGTIQQLFEGHHMNYIECINVDYKSTRKESFYDLQLDVKGCRDVYASFDKYVEVERLEGDNKYHAEQYGLQDAKKGVLFIDFPPVLQLQLKRFEYDFIRDTMVKINDRYEFPLQLDLDREDGKYLSPDADRSIRNLYTLHGVLVHSGGVHGGHYYAYIRPTLSDQWFKFDDERVTKEDVKRALEEQYGGEEELPQANPGFNNAPFKFTKYSNAYMLVYIRESDKEKIICNVDEKDIAEHLRIRLKKEQEEKELKRKEKAEAHLYTIIKVARNEDLLEQIGKDIYFDLVDHDKVRSFRIQKQMPFNLFKEEVAKEFGVPVQFQRYWLWAKRQNHTYRPNRPLTHMEEAQSVGQLREVSNKANNAELKLFLEVEVGLDQRPVAPPEKTKEEILIFFKLYDPLKEEMRYLGRLFVKASGKPAEILTKLNEMAGFGADEEIELFEEIKFEPNVMCEHIDKKATFRASQLEDGDIICFQKAAPVSEQCRYPDVPSFLEYVVRFRSLEKPKEDEFCLELSKLYTYDDVVEKVAHHLGLNDPSKIRLTSHNCYSQQPKPQPIKYRGVDHLSDMLLHYNQTSDILYYEILDIPLPELQGLKTLKVAFHHSTKDEVVIHTVRLPKQSTVGDVINDLKTKVELSHPAAEIRLLEVFYHKIYKIFPLNEKIENINDQYWTLRAEEIPEEEKNFGPHDRIIHVYHFMKDTAQNQQVQNFGEPFFLVIREDETLAEVKVRIQKKLQVPDEEFAKWKFAFLSLGRPEYLQDSDVVASRFQVLSFFLSLSL

SEQ ID NO: 4438 - protein, 1030 aa, Valeriana officinalis
MTMVTQPLDQEDEEMLVPQPEQVEGPQLVEGPQPMEVAQPEAVATVENQAVEEPQTTRHTWKIENFSRQTTKKLYSDVFTVGTFKWRVLIFPKGNNVDHLSMYLDVADSSTLPYGWSRYAQFSLAVVNQIHSKYTVKKDTQHQFHGRESDWGFTSFMALSELYDPGKGFLVNDTCIIEADVAVRKVVDYWTYDSKKETGYVGLKNQGATCYMNSLLQTLYHIPYFRKAVYHMPTTENDIPTGSIPLALQSLFYKLQYNDMSVATKELTKSFGWDTYDSFMQHDVQELNRVLSEKLEDKMKGTVVEGTIQKLFEGHNMNYIECINVDFKSTRKESFYDLQLDVKGCRDVYASFDKYVEVERLEGDNKYHAEEHGLQDAKKGVLFSDFPPVLQLQLKRFEYDFMRDTMVKINDRYEFPLELDLDREDGKYLSPDADRSVRNLYTLHSVLVHSGGVHGGHYYAFIRPTLSEQWFKFDDERVTKEDMKRALEEQYGGEEELPQTNPGFNNAPFKFTKYSNAYMLVYIRESDKEKIICDVDEKEIAEHLRIRLKKEQEEKEDKRRYKAQAHLYTIIKVARDEDLVEQIGKDIYFDLVDHDKVRSFRIQKQMPFNLFKEEVAKEFGIPVPCMRFWIWAKRQNHTYRPNRPLTAQEDSQSVGQLREVSNKTHNAELKLFLEVETGLDLRPIPLPEKTKEDVLLFFKLYDPEKEELRYVGRLYVRSSSKPLEIMARLNELAGFQPDTDLDLFEEVKFEPGVMCERLDKKISFRFSQIEDGDILCFQKHLEPQNEEQYRYPIVSSFLEYVKNRQIVHFRHLERPKEDDFCLELSKQHTYDDVVERVAKKLGLDDPSKIRLTPHNCYSQQPKPHPIKYRVAECLLDMLIHYNQISDILYYEVLDIPLPELQCLKTLKVAFHQAAKDEVVIYNIRLPKQSTVGDVLNEIKTKVELSHPDAELRLLEVFYHKIYKIFPLTEKIENINDQYWTLRAEEIPEEEKNLGLHDRLIHVYHFTKETAQNQMQVQNFGRTLFLDHTRR

SEQ ID NO: 4439 - protein, 1090 aa, Brassica napus
DPAQPMEVSETETAVSTVENQPAAEEPPTLKFTWTIPHFSRINTRKQYSDVFVVGGYKWRILIFPKGNNVDHLSMYLDVADAASLPYGWSRYAQFSLAVVNQVHTRYTIRKETQHQFNARESDWGFTSFMPLSELYDPSRGYLANDTVYIEAEVVVRKVLDYWSYDSKKETGFVGLKNQGATCYMNSLLQTLYHIPYFRKAVYHMPTTENDAPTASIPLALQSLFYKLQYNDTSVATKELTKSFGWDTYDSFMQHDVQELNRVLCEKLEDKMKGTVVEGTIQQLFEGHHMNYIECINVDYKSTRKESFYDLQLDVKGCKDVYASFDKYVEVERLEGDNKYHAEGHGLQDAKKGVLFIDFPPVLQLQLKRFEYDFMRDSMVKINDRYEFPLELDLDREDGKYLSPDADRSVRNLYTLHSVLVHSGGVHGGHYYAFIRPTLSDQWYKFDDERVTKEDLKRALEEQYGGEEELPQTNPGFNNPPFKFTKYSNAYMLVYIRESDKDKIICNVDEKDIAEHLRVRLKKEQEEKEDKRKYKAQAHLFTIIKVARDQDLKEQIGKDIYFDLVDHDKVRSFRIQKQTPFQQFKEEVAKEFGIPVQCQRFWIWAKRQNHTYRPNRPLTPQEELQPVGQIREASNKANTAELKLFLEVELLDERPIPPPEKSKEDILLFFKLYDPEKPELRYVGRLMVKSSSKPMDITGKLNEMAGFAPDEEIELFEEIKFEPGVMCEHLDKKNSFRLCQIEDGDIICFQKPVVNKEIECRYPAVPLFLEYVQNRQLVRFRALEKPKEDEFVLELSKLHTYDDVVERVAEKLGLDDPSKLRLTSHNCYSQQPKPQPIKYRGVDRLSDMLVHYNQTSDILYYEVLDIPLPELQGLKTLKVAFHHSTKEEVVIHNIRLPKQSTVGDVINELKTKVELSHPDAELRILEVFYHKIYKIFPLTERIENINDQYWTLRAEEIPEEEKNIGPNDRLILVYHFAKETGQNQQVQNFGEPFFLVIHEGETLQEIKNRIQKKLHVSDEDFAKWKFAFMSMGRPEYLQDSDVVYNRFQRRDVYGAFEQYLGLEHTDTTPKRAYAANQNRHAYEKPVKIYN

SEQ ID NO: 4440 - protein, 1119 aa, Oryza sativa
MTTSPPPPPPAEQQQQQEEEEVLVPRQELPNGTQPMEVVPSEPAATVENQQIEDPPISRFTWTIENLSRVSTKKLYSEIFVVGGYKWRILIFPRGNNVEYLSMYLDVADSAVLPYGWTRYAQFSLSVVNQMHNKFTIRKETQHQFSARESDWGFTSFMPLGDLYNPSRGYLVNDTCIVEAEVAVCKVVDYWSYDSKKETGYVGLKNQGATCYMNSLLQTLYHIPYFRKAVYHMPTTENDMPSGSIPLALQSLFYKLQYNDSSVSTKELTKSFGWDMHDSFMQHDVQELNRVLSEKLEDKMKGTVVEGTIQQLFEGHHMNYIECINVDMKSTRKESFYDLQLDVKGCQDVYASFDKYVEVERLEGDNKYHAEQYGLQDAKKGVLFIDFPPVLQLQLKRFEYDFMRDTMVKINDRYEFPIQLDLDRDDGKYLSPDADRNVRNLYTLHSVLVHSGGVHGGHYYAFIRPTLSDQWFKFDDERVTKEDAKRALEEQYGGEEELPQTNPGLNNTPFKFTKYSNAYMLVYIRESDKDKIICNVDEKDIAEHLRIRLEKDREEKERRKKEKAEAHLYTIIKVARDDDLTTQIGKDIYFDLVDHDKVPSFRIQKQMPFTQFKEEVAKEFGIPTQFQRFWLWAKRQNHTYRPNRPLTPQEETHTVGQLKEAANKAHNAELKLFLEVELGLDLKPLPLPDKTREDILLFFKLYDPEKEQLRYVGRLFVKASGKPQDILPKLRKMAGFSQDEEIELYEEIKFEPNVMCEYIDNRLLFRACQLEDGDIVCFQKSPKPDTADQYRYPDVPSFLVYIRNRQVVHFRSLEKPKEDDFCLEMSKAFTYDEVVEKVAQKLGVDDPTKIRLTSHNCYSQQPKPQPIKYRGVERLLDMLIHYNQTSDILYYEVLDIPLPELQALKTLKVTYHHGTKDEVSVHSIRLPKNSTVGDVLNDIKSKVELSHPNAELRLLEVFYHKIYKIFAPNEKIENINDQYWTLRAEEVPEEEKNLGPFDRLIHVYHFTKDTQNQTQVQNFGEPFFMVIREDETLSSIKERIQKKLKVPDEDFSKWKFAYISLGRPDYFEDSDTVASRFQRNMYGAWEQYLGLEHPDTAPRKTHNANQNRHSFERPVKIYN

SEQ ID NO: 4441 - protein, 1095 aa, Nicotiana benthamiana
MLVPSSDFPTEGPQPMEVAPANTASTVDAQAVDDPASARFTWTIDNFSRLNVKKLYSDVFNVGGYKWRILIFPKGNNVDNLSMYLDVADSATLPYGWSRHAQFSLAILNRIHNKFTVRKDTQHQFNARESDWGFTSFMPLSELYDPGRGFLVDDAVIVEADVAVRKVIDYWSHDSKKESGCVGLKNQGATCYMNSLLQTLYHIPYFRKAVYHMPTTENDNPSSSIPLALQSLFYKLQYSDTSVSTKELTKSFGWDTYDSFMQHDVQELNRVLCEKLEDKMKGTVVEGTIQQLLEGHHMNYIECINVDYKSTRKESFYDLQLDVKGCRDVYASFDKYVEVERLEGDNKYHAEQHGLQDARKGVLFIDFPPVLQLQLKRFEYDFARDAMIKINDRYEFPLQLDLDRENGKYLSPDADRSVRNLYTLHSVLVHSGGVHGGHYYAYIRPTLSDQWYKFDDERVTKEDTKRALEEQYGGEEELPHTNPGFNNSPFKFTKYSNAYMLVYIRESDKEKIICNVDEKDIAEHLRIRLKKEQEEKEQKRKEKAEAHLYTIIKVARDEDLGEQIGKEIYFDLVDHDKVRSFRIQKQMPFTQFKEEVAKELGIPVQFQRYWLWAKRQNHTYRPNRPLTAQEEVQSVGQLREVSNKANNAELKLFLEVEFGLDLQPFPPPEKTKEDILLFFKLYDPLKEEIRYVGRLFVKGSGKPLEILTKLNELAGFFPDEEIELFEEIKFEPNVMCEHIDGKLSFRGSQLEDGDIICFQKSLRNQDREQYRFPEVPLFLEYVHNRQVVRFRSLEKPKEDEFSLELSKKNNYDEVVEHLARHLGLDDASKVRLTSHNCYSQQPKPQPIRYRGVDRLTEMLSHYNQTSDILYYEVLDIPLPELQGLKALKVTFHHAAKDEVTIHIIRLPKQSTIGDVLNDLKTKVELSRPDAELRLLEVFYHKIYKIFPLNERIENINDQYWTLRAEEIPEEEKNLGPHSRLIHVYHFMKDTSQNQAQIHNFGDPFFLVIHEGDTLTEVKARIQKKLQVPDEEFSKWKFAFLSMGRPEYLEDSDVVSNRFQKRDVYGAWEQYLGLEHIDNAPKRSHAANQVCTCALC

SEQ ID NO: 4442 - protein, 1109 aa, Nicotiana benthamiana
MTMLNPQPLDQQEEEEMLVPHSDLVEGPQPLVDGPQPMEVAPAENASTGENQAVDEPQASRFTWTIDNFSRLSVKKLYSEAFVVGSYKWRVLIFPKGNNVDCLSMYLDVADSSTLPYGWSRYAQFSLAVVNQINPKYSVKKETQHQFNQRESDWGFTSFMLLSDLYDPNKGYLVNDKVVIEADVAVRKVIDYWTYDSKKETGYVGLKNQGATCYMNSLLQTLYHIPYFRKAVYHMPTTENDMPSGSIPLALQSLFYKLQYSDTSVATKELTKSFGWDTYDSFMQHDVQELNRVLCEKLEDKMKGTVVEGTIQKLFEGHHMNYIECINVDFKSTRKESFYDLQLDVKGCRDVYASFDKYVEVERLEGDNKYHAEEHGLQDAKKGVLFIDFPPVLQLQLKRFEYDFMRDTMVKINDRYEFPLELDLDRENGKYLSPDADRSVRNLYTLHSVLVHSGGVHGGHYYAFIRPTLSDQWYKFDDERVTKEDLKRALEEQYGGEEELPQTNPGFNNTPFKFTKYSNAYMLVYIRESDKDKIICDVGEKDIAEHLRIRLKKEQEEKEDKRRYKAQAHLYTIIKVARDEDLREQIGKEIYFDLVDHDKVRSFRIQKQMPFNLFKEEVAKELGIPVQFQRFWIWAKRQNHTYRPNRPLTPQEELQTVGQLREVSNKTNNAELKLFLEVDPGLDLVPSPPPDKSKDDILLFFKLYDPEKEELQYVGRLFVKSTSKPSEILPKLNELAGFAPDQEIDLFEEIKFEPSVMCERLDKKASFRFSQIEDGDIICFQKKASPEVEEQVRFPDVPAYLEYVKNRQIVHFRALEKPKEDDFCLELAKSDTYDDVVERLAQRLGVDDPSKIRLTPHNCYSQQPKPNPIKYRSVDHLVDMLIHYNQISDILYYEVLDIPLPELQCLKTLKVAFHHPTKDEVEILNVRLPKQSTVGDVLNEIKSKVELSHPNADLRLLEVFYHKIYKIFPLAEKIENINDQYWTLRAEEIPEEEKNLGPHDRLIHVYHFTKATPQNQMQVQNFGEPFFLVIHECETLAEIKVRIQKKLQVPDEEFSKWKFAFLSLGRPEYLQDSDVVSSRFQRRDVYGAWEQYLGLEHADYTSKRPYVSQ

SEQ ID NO: 4443 - protein, 1107 aa, Olea europaea
MLVPHSDLVEGPQPLVEGPQPMEVGPAENPGTVENQASDEPQASRFTWMIENFSRLNVKKLYSEVFIVGGYKWRVLIFPKGNNVDYLSMYLDVADAATLPYAWSRYAQFSLAVVNQMHSKYTVKKDTHHQFNQRESDWGFTSFMPLSELYDPSKGYLVNDTCVIEADVAVRKAIDYWTYDSKKETGYVGLKNQGATCYMNSLLQTLYHIPYFRKAVYHMPTTENDMPSGSIPLALQSLFYKLQYNDTSVATKELTKSFGWDTYDSFLQHDVQELNRVLSEKLEDKMKGTVVEGTIQKLFEGHHMNYIECINVDFKSTRKESFYDLQLDVKGCKDVYDSFDKYVEVERLEGDNKYHAEEHGLQDARKGVLFIDFPPVLQLQLKRFEYDFMRDTMVKINDRYEFPLELDLDRDNGKYLSPEADRSVRNLYMLHSVLVHSGGVHGGHYYAFIRPTLSDQWYKFDDERVTKEDMKRALEEQYGGEEELPQTNPGYNNTPFKFTKYSNAYMLVYIRVGDKDKIICDVDEKDIAEHLRMRLKKEQEVKEDKRRYKAQAHLYTIIKVARDEDLKEQIGKDIYFDLVDHDKVRSFRIQKQTPFNLFKEEVAREFGIPVQFQRFWIWAKRQNHTYRPNRPLTPQEEAQTVGALREVSNKAHNAELKLFLEVKHGQELHPFPPPDKTKEDILLFFKLYDPEKEELRYVGRFFVKSSGKPMEILTKLNELAGFAPDEEIELFEEIKFEPTVMCERLDRRASFRFSQIEDGDIICFQKKLLPEGEEKFRYPGVPSFLEYVKNRQTVHFRALERPKEDEFCLELAKNHTYDDVVERVAQHLGLDDPSKIRLTPHNCYSQQPKPNPIKYRSVDRLLDMLVHYNQISDILYYEVLDIPLPELQCLKTLKVAFHHATKDEAVVLNIRLPRQSTVGDVLNEIKTKVELSHPNAELRLLEVFYHKIYKIFPLNEKIENINDQYWTLRAEEIPEEEKNPGPNSRLIHVYHFKKENAQNQVQVQNFGEPFFLVIHDAEILADVKMRIQKKLQVPDEEFSKWKFAFLSLGRPEYLEDSDIVSSRFQRRDVYGAWEQYLGLEHSDTTPKRAYAASQNRHTFEKAVKIYN

SEQ ID NO: 4444 - protein, 1120 aa, Panicum virgatum
MTTSPPPPPPAESQQQQQEEDEVLVPHQELPNGTQPMEVVPAEPAATVENQQIEDPPISRFTWTIENLSRVSTKKLYSEVFIVGGYKWRILIFPRGNNVEFLSMYLDVADSGVLPYGWTRYAQFSLSVVNQIHNKFTIRKETQHQFSARESDWGFTSFMPLGELYNPSRGYLVNDTCIVEAEVAVCKVVDYWSYDSKKETGYVGLKNQGATCYMNSLLQTLYHIPYFRKAVYHMPTTENDMPSGSIPLALQSLFYKLQYNDSSVSTKELTKSFGWDMHDSFMQHDVQELNRVLSEKLEDKMKGTVVEGTIQQLFEGHHMNYIECINVDFKSTRKESFYDLQLDVKGCQDVYASFDKYVEVERLEGDNKYHAEQHGLQDAKKGVLFIDFPPVLQLQLKRFEYDFMRDTMVKINDRYEFPLQLDLDRDNGKYLSPDADRNVRNLYTLHSVLVHSGGVHGGHYYAFIRPTLSDQWFKFEDERVTKEDAKKALEEQYGGEEELPQTNPGLNNTPFKFTKYSNAYMLVYIRESDKDKIICNVDEKDIAEHLRIRLEKDREEKERRKKEKAEAHLYTIIKVARDDDLKAQIGKDIYFDLVDHDKVPSFRIQKQMTFTQFKEEVAKEFGIPTQFQRFWLWAKRQNHTYRPNRPLSPQDEAHSVGQLKELVNKAHNAELKLFLEVELGLDLKPLPLPEKTRDDIFLFFKLYDPEKEELRYVGRLFVKASGRPQDILPKLRMLAGFSQDDDIELFEEIKFEPNVMCEYIDNRLLFRSCQLEDGDIICFQKSPKPDSADRYRFPDVPSFLVYIRNRQVVHFRSLEKPKEDDFCLEMSKIFTYDEVVEKVAQKLGVDDPSKIRLTSHNCYSQQPKPQPIKYRGVERLLDMLIHYNQTSDILYYEVLDIPLPELQALKTLKVTYHHATKDEVSVHSIRLPKNSTVGDVLNDIKSKVELSHPNAELRLLEVFYHKIYKVFAPSEKIENINDQYWTLRAEEVPEEEKNLGPFDRLIHVYHFTKDTQNQTQVQNFGEPFFMVIREDETLSSIKERIQKKLKVPDEDFSKWKFAYISLGRPDYFEDSDIVATKFQRNMYGAWEQYLGLEHPDTAPRKAHTVNQNRHSFERPVKIYN

SEQ ID NO: 4445 - protein, 1095 aa, Nicotiana benthamiana
MLVPHSDLVEGPQPLVEGPQPMEVAPAENASTGESQAVDEPQVSRFTWTIDNFSRLSVKKLYSEAFVVGSHKWRVLIFPKGNNVDCLSMYLDVADSSTLPYGWNRYAQFSLAVVNQINPKYSVKKETQHQFNQRESDWGFTSFMLLSDLYDPNKGYLVNDKVVIEADVAVRKVIDYWTYDSKKETGYVGLKNQGATCYMNSLLQTLYHIPYFRKAVYHMPTTENDMPSGSIPLALQSLFYKLQYSDTSVATKELTKSFGWDTYDSFMQHDVQELNRVLCEKLEDKMKGTVVEGTIQKLFEGHHMNYIECINVDFKSTRKESFYDLQLDVKGCRDVYASFDKYVEVERLEGDNKYHAEEHGLQDAKKGVLFIDFPPVLQLQLKRFEYDFMRDTMVKINDRYEFPLELDLDRENGKYLSPDADRSVRNLYTLHSVLVHSGGVHGGHYYAFIRPTLSDQWYKFDDERVTKEDLKRALEEQYGGEEELPQTNPGFNNTPFKFTKYSNAYMLVYIRESDKDKIICDVGEKDIADHLRIRLKKEQEEKEDKRRYKAQAHLYTIIKVARDEDLREQIGKEIYFDLVDHDKVRSFRIQKQMPFNLFKEEVAKELGIPVQFQRFWIWAKRQNHTYRPNRPLTPQEELQTVGQLREVSNKTNNAELKLFLEVDLGPDLVPSPPPDKSKDDILLFFKLYDPEKEELQYVGRLFVKSTSKPIEILPKLNELAGFAPDQEIDLFEEIKFEPSVMCERLDKKASFRFSQIEDGDIICFQKKASPEVEEQVRFPDVPSYLEYVKNRQIVHFRALEKPKEDDFCLELAKSDTYDDVVERVAQRLGVDDPSKIRLTPHNCYSQQPKPNPIKYRSVDHLVDMLIHYNQISDILYYEVLDIPLPELQCLKTLKVAFHHSTKDEVEILNVRLPKQSTVGDVLNEIKSKVELSHPTAELRLLEVFYHKIYKILPLTEKFENINDQYWTLRAEEIPEEEKNLGPHDRLIHVYHFTKETPQNQMQVQNFGEPFFLVIREGETLAEIKVRIQKKLQVPDEEFSKWKFAFLSLGRPEYLQDSDIVSSRFQRRDVYGAWEQYLGLEHADNTSKRPYVSQVN

SEQ ID NO: 4446 - protein, 1119 aa, Brachypodium distachyon
MTISQPPPAPTEPQPQQEEEEVLVPHQELPNGAQPMEVVPAEPAATVENQQIEDPPISRFTWTIDNLSRVNTKKLYSETFVVGGYKWRVLIFPRGNNVEFLSMYLDVADSAVLPYGWSRYAQFSLSVVNQIHNKFTIRKETQHQFSARESDWGFTSFMPLGELYNPSRGYLVNDTCIVEAEVAVCKVVDYWSYDSKKETGYVGLKNQGATCYMNSLLQTLYHIPYFRKAVYHMPTTENDMPSGSIPLALQSLFYKLQYNDSSVSTKELTKSFGWDMHDSFMQHDVQELNRVLSEKLEDKMKGTVVEGTIQQLFEGHHMNYIECINVDFKSTRKESFYDLQLDVKGCQDVYASFDKYVEVERLEGDNKYHAEQHGLQDAKKGVLFIDFPPVLQLQLKRFEYDFMRDTMVKINDRYEFPLQLDLDRDDGKYLSPDADRNVRNLYTLHSVLVHSGGVHGGHYYAFIRPTLSDQWFKFDDERVTKEDPKRALEEQYGGEEELPQTNPGLNNTPFKFTKYSNAYMLVYIRESDKDKIICNVDEKDIAEHLRIRLEKDREEKERRKKEKAEAHLYTIIKVARDDDLTAQIGKDIYFDLVDHDKVPSFRIQKQMPFTQFKEEVAKDLGIPTQFQRFWLWAKRQNHTYRPNRPLTPQEEALTVGLLKEAANKAHNAELKLFLEVELGLDLKTIALPDKTREDILLFFKLYDPEKEQLRYVGRFFVKASGRPLDILPKLRKMAGFSQDDDIELYEEIKFEPNVMCEYIDNRVIFRSCQLEDGDIVCFQKSPKPDNADQYRYPDVPSFLVYIRNRQVVHFRSLEKPKDDDFCLEMSKIFTYDEVVEKVAQKLGVDDPSKIRLTSHNCYSQQPKPQPIKYRGVERLLDMLIHYNQTSDILYYEVLDIPLPELQALKTLKVTYHHATKDEVSVHSIRLPKNSTVGDVLNDIKSKVDLSHPDAELRLLEVFYHKIYKIFAPSEKIENINDQYWTLRAEEVPEEEKNLGPFDRLIHVYHFTKDTQNQTQVQNFGEPFFMVIREDETLSSIKERLQKKLKVSDEDFSKWKFAYISLGRPDYFEDSDTVATRFQRNMYGAWEQYLGLEHADTAPRKAHTANQNRHSFERPVKIYN

SEQ ID NO: 4447 - protein, 1119 aa, Secale cereale
MTISTPPPAPAEPQPQQEEEEVLVPHQELPNGTQPMEVVPAEPAATVENQPTEDAPISRFTWTIDNLSRVNTKKLYSETFVVGGYKWRVLIFPRGNNVEFLSMYLDVADSAVLPYGWTRYAQFSLSVVNQIHNKFTIRKETQHQFSARESDWGFTSFMPLSELYNPSRGYLVNDTCVIEAEVAVCKVVDYWSYDSKKETGYVGLKNQGATCYMNSLLQTLYHIPYFRKAVYHMPTTENDMPSGSIPLALQSLFYKLQYNDSSVSTKELTKSFGWDMHDSFMQHDVQELNRVLSEKLEDKMKGTVVEGTIQQLFEGHHMNYIECINVDFKSTRKESFYDLQLDVKGCQDVYASFDKYVEVERLEGDNKYHAEQHGLQDAKKGVLFIDFPPVLQLQLKRFEYDFMRDTMVKINDRYEFPLQLDLDRDDGKYLSPDADRNVRNLYTLHSVLVHSGGVHGGHYYAFIRPTLSDQWFKFDDERVTKEDAKRALEEQYGGEEELPQTNPGLNNTPFKFTKYSNAYMLVYIRESDKDKIICNVDEKDIAEHLRIRLEKDREEKERRKKEKAEAHLYTIIKVARDDDLTAQIGKDIYFDLVDHDKVPSFRIQKQMPFTQFKEEVAKELGIPTQFQRFWLWAKRQNHTYRPNRPLTPQEEALTVGQLKEAANKAHNAELKLFLEVELGLDLKPLALPEKTREDILLFFKLYDPEKEQLRYVGRLFVKASGRPQDILPKLRKMAGFLQDDDVELYEEIKFEPNVMCEYIDNRIIFRSCQLEDGDIVCFQKSPKPDTADQFRYPDVPSFLVYIRNRQVVHFRSLEKAKEDDFCLEMSKIFTYDEVVEKVAQQLGVDDPSKIRLTSHNCYSQQPKPQPIKYRGVERLLDMLIHYNQTSDILYYEVLDIPLPELQALKTLKVTYHHATKDEVSVHSIRLPKNSMVGDVLSDIKSKVDLSHPDAELRLLEVFYHKIYKIFAPSEKIENINDQYWTLRAEEVPEEEKNLGPFDRLIHVYHFTKDTQNQTQVQNFGEPFFMVIREDEPLSSIKERLQKKLKVSDEDFSKWKFAYISLGRPDYFEDSDTVATRFQRNMYGAWEQYLGLEHPDTAPRKAHSANQNRHSFERPVKIYN

SEQ ID NO: 4448 - protein, 367 aa, Amorphophallus konjac
MCEHIDKRLTFRSSQLEDGDIICYQKSPPLENDEMCRYPDVPSFLEYVHNRQVVHFRSLERPKEEDFCLELSKLYTYDDVVERVAHHIGLDDPTKIRLTSHNCYSQQPKPQPIKYRGVEHLSDMLAHYNQTSDILYYEVLDIPLPELQGLKTLKVAFHHATKDEVVIHSIRLPKNSTVGDVLNDLRAKVELSHPNAELRLLEVFYHKIYKIFPVNEKIENINDQYWTLRAEEIPEEEKNLGPHDRLIHVYHFTKDAAQNHMQVQNFGEPFFLVIHEGETLADAKVRIQKKLQVPDEEFSKWKFAFLSLGRPEYLQDSDIVSQRFQRRDIYGAWEQYLGLEHSDTAPKRAYTTNQSRHTFEKPVKIYN

SEQ ID NO: 4449 - protein, 1103 aa, Pinus taeda
MLVPHPDFNNDTIEPMEGTVGQADTVSTAENQPIIEDPPTSKFTWTIEHFTKLNVKKHYSETFIVGGYKWRILIFPRGNNVDHLSMYLDVADSTTLPYGWSRYAHFSLAVANQIHSKYSVRKDTQHQFNARESDWGFTSFMPLLDLYDSGKGYLVNDTLVIEAEVTVQRGMDYLQYDSKKETGFVGLKNQGATCYMNSLLQTLYHMPYFRKAVYHMPTTENDVPSNSIPLALQSLFYKVQYNDTSVSTKDLTKSFGWDTYDSFMQHDVQELNRVLSEKLEDKMKGTAVEGTIQQLFEGHHMNYIECINVDYKSTRKESFYDLQLDVKGCRDIYASFDKYVEVEKLEGDNKYHAENYGLQEARKGVLFIDFPPVLQLQLKRFEYDFMRDTMVKINDRYEFPLQLDLDRENGKYLSPDADRSVRNLYTLHSVLVHSGGVHGGHYYAFIRPTLSEQWYKFDDERVTKEDVKRALEEQYGGEEELPQTNPGLNNTPFKFTKYSNAYMLVYVRESDKDKIICNVDLKDIAEHLRVRLKKEQEEKELKRKEKAEAHLYTIIKVARDQDLSNQIGKDIYFDLVDHDKVRTFRIQKQVPFISFKEEVAKEFGIPVQFQRYWLWAKRQNHTYRPNKPLTQPEESQSVGILRETSNKAHIAELRLFLEAEYGPDHRLLPPPDKTKDDILLFFKLYDPEREELRYVGRLFVKALGKPIEIITKLNAMAGFPPDEEIDLYEEIKFEPNVMCEPIEKRITFRSSQLEDGDIICFQRSLATSEEDIHRFPDVPSFLDYVHNRQIVHFRRLDRSKEDDFCLELSKLSTYDDVVERVAQQLDLDDPSKIRLTAHNCYSQQPKPQPIRFRGVDHLSDMLIHYNQTSDILYYEILDIPLPELQGLKTLKVAFHHSTKDEVSVHSIRLPKQSTVGDVINELKTKVELSNPNADIRLLEVFYHKIYKIFPPNEKIENINDQYWTLRAEEVPEEEKNIGPQDRLIHVYHFTKDASQNHVVQNFGEPFFLAIHEGETLAEVKERIKMKLHVPDEEFCKWNFAFISLGRPEYLQDADIVSTRFQKRDVYGAWEQYLGLEHSDSAPKKSHQANHNRHTFEKPVKIYN

SEQ ID NO: 4450 - protein, 1018 aa, Pseudotsuga menziesii
MLVPHPDFNNDTIEPMEVGQVDTVSTTATVGGDTVSSAENQPIIEDPPTSKFTWTIEHLSKINLKKHYSETFIVGGHKWRILIFPRGNNVDHLSMYLDVADSNTLPYGWSRYAHFSLAVANQIHSKYTIRKDTQHQFNARESDWGFTSFMPLLDLYDSGKGYLVNDTLVIEAEVTVQRGMDYLQYDSKKETGFVGLKNQGATCYMNSLLQTLYHMPYFRKAVYHMPTTENDVPSNSIPLALQSLFYKVQYNDTSVSTKDLTKSFGWDTYDSFMQHDVQELNRVLSEKLEDKMKGTAVEGTIQQLFEGHHMNYIECINVDYKSTRKESFYDLQLDVKGCRDVYASFDKYVEVEKLEGDNKYHAEHYGLQEARKGVLFIDFPPVLQLQLKRFEYDFMRDTMVKINDRYEFPLQLDLDRENGKYLSPDADKSVRNLYTLHSVLVHSGGVHGGHYYAFIRPTLSDQWYKFDDERVTKEDIKRALEEQYGGEEELPQTNPGLNNAPFKFTKYSNAYMLVYVRESDKDKIICNVDEKDIAEHLRVRLKKEQEEKELKRKEKAEAHLYTIIKVARDKDLSNQIGKDIFFDLVDHDKVRTFRIQKQVPFISFKEEVAKEFGIPVQFQRFWLWAKRQNHTYRPNRPLTQAEEAQTVGYLRETSNKAHTVELRLFLEAEYSPDLRLLPLPDKTKDDILLFFKLYDPEKEELRFVGRLFVKAAGRPVEIIVKLNAMAGFPPDEEIDLFEEIKFEPNVMCELIDKRITFRASQLEDGDIICFQRSLTSEEDIHRYPDVPSYLEYVHNRQIVHFRRLDKPKEDDFCLELSKLFTYDDVVERVAQQLDLDDPSKIRLTAHNCYSQQPKPQPIRYRGVDHLSDMLTHYNQTSDILYYEILDIPLPELQGLKTLKVAFHHSTKDEVSVHSIRLPKQSTVGDVINELKTKVELSSPNADIRLLEVFYHKIYKIFPLNEKIENINDQYWTLRAEEVPEEEKNLGPQDRLIHVYHFTKDASQNHNVQNFGSLSFGYP

SEQ ID NO: 4451 - protein, 480 aa, Panicum virgatum
MARRPDAEAPLLGKPDAASPPATPPPPPKRNKYPFFCAVLASMTSVLMGYNVAVMSGAQIFMAEDLGISDAQVEVLSGVISIYSLAGALLAGWTSDRLGRRLTIVLANVFFLAGPLIMALAGGYAALMAGRFVAGVGSGYALVIAPVYAAEIAPASSRGLLTSLPEIFINTGVMLSYVSNLAFSGLPVHLSWRVMFAAAAVPTVFLAAGVLTMPESPRWLGMKGRVAEAKAVLDRTSDTPAEAEQRLLEIEAVVTSGGGGAWKEVATKAGVRRVLAIVLTLQFFQQASGVDSVVLYGPRVLAMAGVTSNTLLLSLNVLFGAAKAGSILVAMVLVDRVGRRPLLLASTGGMTAALLVLGSLFAAFTGAKDDAAVAAVSVAAVVAFVVAFSVGLGPLAWVYSSEILPLRLRGQGAGLGTAMNRIMSGVVTMTFISLYQAITMAGAFYLYAAIAAASFVFVYACLPETRGRSLEDMEELFHTK

SEQ ID NO: 4452 - protein, 478 aa, Zea mays
MAAHRPNAAAPLLAKLDATATPPAKRNKYPFFCAVLASMTSVLMGYNVAVTSGAQIFMAEDLGMSDAQIEVLSGVINIYSLVGALLAGWTSDRLGRRLTIVLANAFFLVGPLAMALAGGYTLLMVGRFIAGVGVGYALVIAPVYAAEIAPASSRGLLSSLPEIFINTGVMLSYVSNLAFSGLPVHLSWRVMFAAGVVPTVFMAAGVFTMPESPRWLVMKGRVAEAKAVLDKTSDTPAEAEQRLLEIEDVVMDSSGDSGAWKEVATKAGVQRVLATVVTLQFFQQASGIDSVVLYGPRVLAMAGVTSNSLLLSLNILFGVAKVGSILIAMALADRVGRRPLLLVSTSGMTVALLVLGSLFAVFAGAKDNAAVAAVSVVAVMAFVMAFSVGLGPLAWVYSSEILPLRLRGQGAGLGTAMNRIMSGVITMTFISLYQGITMAGAFYLYAAIAAASFVFVYACLPETRGRSLEDMEELFHTK

SEQ ID NO: 4453 - protein, 485 aa, Setaria italica
MAQRPDAEAPLLGKPGAASPPSPPAKRTNKYPFFCAVLASMTSVLAGYNVAVMSGAQIFMAEDLGVTDAQVEVLSGVINVYSLVGALLAGWTSDRLGRRLTIVLANVFFLVGPLAMTLAGGYAVLMAGRFVAGVGVGYAFVIAPVYAAEIAPASSRGLLSSLPEIFINSGVMLSYVANLVFSGLPVHLSWRLMFAAGVVPTVFLAAGVLTMPESPRWLAMKGRVAEAKAVLDKTSDTPAEAEQRLLEIEDVVNGGGRSGEGSGGGAWKEVATKAGVRRVLAIVLTLQFFQQSSGIDSVVLYGPRVLAMAGVTSNTLLLSLNVLFGVAKAGSILIAMALADRVGRRPLLLVSTGGMTASLLVLGSLFAAFTGAKDDAAVAAVSFAAVVAFVVSFSVGFGPLAWVYSSEILPLRLRGQGAGLGTAMNRITSGVVTMTFISLYQAITMAGAFYLYAAIAAASFVFVYACLPETRGRSLEDMEELFHTK

SEQ ID NO: 4454 - protein, 472 aa, Panicum virgatum
MAHQPGDAEAPLLAKPAAKRNKYPFFCAVLASMTSVLTGYHMAVMSGAQIFMAEDLGISDAQVEVISGVINIYSLVGALLAGWTSDRHGRRLTIVLANVFFLAGPLATALGGGYAALMVGRFIAGLGSGYALVVAPVYAAEIAPASSRGLLTSLPEIFMNTGAMLSYVSNLAFSGLPVHLSWRVMFAVAVVPTVFLAAGVLTMPESPRWLAMKGRVAEAKAVLDKTSDTPAEAEQRLLEIEAVVSSGEGGGGAWKEVATKAGVRRVLAIVLTLQFFQQSSGIDTVVMYAPRVLAMAGVTSNTLLLSLNVLFGVAKAGSVLIAMALADRVGRRPLLLASTGGMTASLLVLGSLFVAFAGAKDDAAVAAVSAAAVVAFVVAFSVGLGPLAWAYSSEILPLRLRGHGAGLGTALNLFVSGVVTMTFISLYQAITMAGAFYLYAAVAAASFVFIYTCLPETMGRSLEDMEELFHTK

SEQ ID NO: 4455 - protein, 472 aa, Panicum virgatum
MAHQPGDAEAPLLAKPAAKRNKYPFFCAVLASMTSVLTGYHMAVMSGAQIFMAEDLGISDAQVEVLSGVINIYSLVGALLAGWTSDRHGRRLTIVLANVFFLAGPLATALGGGYAALMVGRFIAGLGSGYALVVAPVYAAEIAPASSRGLLTSLPEIFMNTGAMLSYVSNLAFSGLPVHLSWRVMFAVAVVPTVFLAAGVLTMPESPRWLAMKGRVAEAKAVLDKTSDTPAEAEQRLLEIEAVVSSGEGGGGAWKEVATKAGVRRVLAIVLTLQFFQQSSGIDTVVMYAPRVLAMAGVTSTTLLLSLNVLFGIAKAGSVLIAMALADRVGRRPLLLASTGGMTASLLVLGSLFVAFAGAKDDAAVAAVSAAAVVAFVVAFSVGLGPLAWAYSSEILPLRLRGHGAGLGTALNLFVSGVVTMTFISLYKAITMAGAFYLYAAVAAASFVFIYTCLPETMGRSLEDMEELFHTK

SEQ ID NO: 4456 - protein, 487 aa, Oryza sativa
MAPDVEARLLAASSKPATAAAASLPRRNKYPFFCAVLASMTSVLMGYNVAVTSGAQIFMAEDLGVSDAQIEVLSGAINIYSLVGALLAGWTSDRLGRRLTIVLTNGFFLAGPLVMSLAGGYAALMAGRFVAGIGVGYALVIAPVYAAEISPASSRGLLSSLPEIFINGGVMLSYVSNFAFSGLPVHLSWRLMFAAGVVPTVFLAAGVLTMPESPRWLAMKGRRGEARVVLDRTSDTPAEAEQRLQEIEDVVAAAGSVAGNGNGGGGAWKEVATKPGVRRVLAIVLTLQFFQQASGIDSVVLYGPRVLAAAGVASNTLLLGLNVVFGVAKASSILVAMALTDRVGRRPLLLASTGGMTASLLALGSVFAAFGGARDDAAVAAGAAVAVVVAFVCAFSVGIGPLAWVYSSEILPLRLRGQGAGVGTAMNRVVSGVVTMTFISLYGAITMAGAFYLYAAIAAASFVFIYACLPETRGRSLEDMEELFHTK

SEQ ID NO: 4457 - protein, 486 aa, Avena sativa
MEEQHRLDNAEAPLLAAAATKPDGAASSSPTRNKYPFFCAVLASMTSVLMGYNVAVTSGAQIFMAEDLGLSDTQIELLSGAINIYSLVGALLAGWTSDRLGRRLTIVLTNGFFLVGPLIMTLASGYAALMAGRFIAGIGVGYALVIAPIYAAEIAPASSRGLLSSLPEIFINTGVMLSYVSNFAFSTLPAHLSWRLMFAAGVVPTVFLAAGVLTMPESPRWLAMKGRTDEAKAVLDRTSDTLAESQQRLLEIQEVVDTDSNGAGGGAWKEVATKAGVRRVLATVLALQFFQQASGIDSVVLYGPRVLAMAGVTSNTLLLGLNVLFGVAKAGSILIAMVLADRVGRRPLLLVSAGGMTASLLVLGSVFAAFGGAKDDAVVAAVAVAAVVAFVCTFSVGFGPLAWVYSSEILPLRLRGQGAGLGTAMNRVMSGIVTMTFISLYGAITMAGTFYLYAAVTAASFVFIYTCLPETRGRNLEDMEQLFRTK

SEQ ID NO: 4458 - protein, 137 aa, Panicum virgatum
MCLLVRMLSTRALCAMACPAADVAVMSGAQIFMAEDLGISDAQVEVFSGVINIYSLAGALLAGWTSDRLGRRLTIVLANVFFLAGPLAMALAGGYVCRAHGGPLRRRRRLRVRARHRARLRRRDRARVVPRSPHLAS

SEQ ID NO: 4459 - protein, 483 aa, Triticum aestivum
MEEEQHRQDSEAPLLAASKPDGAASSSPPRNRFPFFCAVLASMTSVLMGYNVAVMSGAQIFMAEDLGVSDTQIELLSGAINIYSLVGALLAGWTSDRLGRRLTIVLTNGFFLVGPLIMTLAGGYTALMAGRFISGIGVGYALVIAPIYAAEIAPASSRGLLSSLPEIFINTGVMLSYVSNFAFSALPAHLAWRLMFAAGVVPTVFLAAGVLTMPESPRWLAMKGRLDEAKAVLDRTSDTLADAEQRLLEIEEVVDAGSNGGGSTWNEVATKAGVSRVLATVLALQFFQQASGIDSVVLYGPRVLAMAGVTSNTLLLGLNVLFGVAKAGSILIAMALADRVGRRPLLLVSTGGMTASLLVLGSVFAAFAGAKDDAAVAAVAVAAVVAFVCTFSVGFGPMAWVYSSEILPLRLRGQGAGLGTAMNRVMSGIVTMTFISLYGAITMAGAFYLYAAVAAASFVFIYTCLPETRGRNLEDMEQLFRTK

SEQ ID NO: 4460 - protein, 485 aa, Hordeum vulgare
MEQQHRPDSESEAPLLAASKPDGAASSSPRRNRFPFFCAVLASMTSVLTGYNVAVMSGAQIFMAEDLGVSDTQIELLSGAISIFSLVGALLAGWTSDRLGRRLTIVLTNGFFLVGSLIMTLAGGYTALMAGRFVAGIGVGYALVIAPVYAAEIAPASSRGLLSSLPEIFINTGVMLSYVSNFAFSALPAHLSWRLMFAVGVVPTVFLAAGVLTMPESPRWLAMKGRLDEAKAVLDRTSDTLAEAEQRLLEIEEVVVAGASNGAGGTWNEVTTKAGVRRVLATVLALQFFQQASGIDSVVLYGPRVLAMAGVTSNNLLLGLNVLFGVAKAGSILIAMALADRVGRRPLLLVSTGGMTASLLVLGSVFAAFAGAKDDAAVAAVAVAAVVAFVCTFSVGLGPLAWVYSSEILPLRLRGQGAGLGTAMNRVMSGIVTMTFISLYGAITMAGTFYLYAAVAAASFAFIYTFLPETRGRNLEDMEQLFRTK

SEQ ID NO: 4461 - protein, 482 aa, Brachypodium distachyon
MDAAEEPLLAAASTKPDGAPPPRNKYPFFCAVLASMTSVLTGYNVAVMSGAQIFIAEDLGVSDTQIELLSGAINIYSLVGALLAGWTSDRLGRRLTIVLTNAFFLLGPLTMSLAAGYPALMAGRFVSGVGVGYALVIAPVYAAEISPASSRGLLTSLPEIFINTGVMLSYVSNLVFSGLPAHLSWRLMFAAGVVPTVFLAAGVLTMPESPRWLAMKGRTEEARAVLGRTSDTPAEAQQRLLEIQEVLIVSVPGSGNGNGNNSAWKEAASKAGVRRVLATVLALQFFQQASGIDSVVLYGPRVLAMAGVTSNALLLGLNVLFGVAKAGSILIAMALADRVGRRPLLLVSTGGMTLSLLVLGSVFAAFAGVKDDAAVAAVAVVAVVAFVCTFSVGLGPLAWVYSSEILPLRLRGQGAGLGTAMNRVVSGLVTMTFISLYGAITMAGTFYLYGAVAAASFVFIYTCLPETRGRNLEDMEQLFRTK

SEQ ID NO: 4462 - protein, 456 aa, Secale cereale
TRNRFPFFCAVLASMTSVLMGYNVAVMSGAQIFMAEDLGVSDTQIELLSGAINIYSLVGALLAGWTSDRLGRRLTIVLTNGFFLVGPLIMTLAGGYTALMVGRFISGIGVGYALVIAPVYAAEIAPASSRGLLSSLPEIFINTGVMLSYVSNFAFSALPAHLSWRLMFAAGVVPTVFLAAGVLTMPESPRWLAMKGRLDEAKAVLDRTSDTLAEAEQRLLEIEEVVDAGGSNGDGGTWNEVATKAGVRRVLATVLALQFFQQASGIDSVVLYGPRVLAMAGVTSNTLLLGLNVLFGVAKTGSILVAMALADRVGRRPLLLVSTGGMTASLLVLGSVFAAFAGAKDDAAVAAVAVAAVVAFVCTFSVGFGPMAWVYSSEILPLRLRGQGAGLGTAMNRVMSGIVTMTFISLYGAITMAGAFYLYAAVAAASFVFIYTCLPETRGRNLEDMEQLFRTK

SEQ ID NO: 4463 - protein, 435 aa, Pennisetum glaucum
VAVMSGAQIFMAADLGVTDAQVEVLSGVINICSLVGALLAGWTSDRLGRRLTIVLANVFFLVGPLAMTLAGGYAVLMAGRFVAGVGVGYAFVIAPVYAAEIAPASSRGLLSSLPEIFINTGVMLSYVSNLAFSGLPVHLSWRVMFAAGVVPTVFLGAGVLTMPESPRWLAMKGRVSEAKAVLDKTSDTAAEAEQRLLEIEDVVNGGGRSGEGGGSAWKEVATKAGVRRVLATVLTLQFFQQSSGIDSVVLYGPRVLAMAGVTSNTLLLSLNVLFGVAKAGSILIAMALTDRVGRRPLLLASTGGMTVSLLVLGSLFAAFTGAKDDVAVASLSFAAVVAFVVSFSVGLGPLAWVYSSEILPLRLRGQGAGLGTAMNRIISGVVTMTFISLYQAITMAGAFYLYAAIAAASFVFVYACLPETRGRSLEDMEELFHTK

SEQ ID NO: 4464 - protein, 486 aa, Panicum virgatum
MGHQPRDAEAPLLAKPDAAAPAPAPAPAVKRNKYPFFCAVLASMTSVLTGYNVAVMSGAQIFMVEDLGISDAQVEVLSGVINIYSLAGALLAGWTSDRLGRRLTIVLANVLFLAGPLCMTLAGGYKALMVGRFIAGIAVGYDFVIAPIYAAEISPASSRGLLTSVPEIFNNTGVMLSYVSNLAFSGLSPHLSWRVMFAAGAVPPVFLAAGTLTMPESPRWLAMKGRVAEAKSVLHRMSDTPAEAERRLLEIEDVVSGGAQGKGSSSAWREAAAKPGVRRVLAMVLTLQFFQQASGIDSVVLYGPRILAAAGVASNTSLLSLNILFGVAKAGSILIAMALVDRAGRRPLLLVSTGGMTASLLLVGSLFAASAGTRGGAAASAASVAAVVAYVVFFSMGLGPMAWVYSSEILPLRLRGQGAGLGTAMNRTMCAVVIMTFITLYKAITMAGAFYLYAAIAAAAFVFVYACLPETRGRSLEDMEELFHTK

SEQ ID NO: 4465 - protein, 485 aa, Setaria italica
MVSPRDAEAPLLSEPDDAAAPAPAPGKRNKYPFFCAVLASMTSVLTGYNVAVMSGAQIFMAEDLGISDAQIEVLSGIINLYSLAGALLAGWTSDRLGRRLTIVLANVLFLLGPLCMTLAGGYNALMVGRFIAGIAVGYDFVIAPIYAAEIAPASSRGLLTSVPEIFNNTGVMLSYVSNLAFSGLPAHLSWRVMFAAGVVPPVFLAVGTLTMPESPRWLVMKGRVAEAKAVLDRTSDTAAEAEQRLLEIVDVVSGDSGGGKGRSSGAWKEAAAKPGVRRVLAMVLTLQFFQQASGIDSVVLYGPRILATAGVTSTSVLSLNVLFGVAKAGSILIAMALVDRAGRRPLLLVSTGGMTASLLLVGSLFTASAGAAKQDAVASTASVAAVVSYVVFFSMGLGPMAWVYSSEILPLRLRAQGAGLGTAMNRVMCAVVIMTFITLYKAITMAGAFYLYAAIAGAAFVFVYTCLPETKGRSLEDMEELFHTK

SEQ ID NO: 4466 - protein, 488 aa, Panicum virgatum
MAHQPRAAAEAPLLAKPDAAVPAPAAKRNKYPFFCAALASMTSVLTGYNVAVMSGAQIFMAEDLGISDAQVEVLSGVINLYSLAGALLAGWTSDRLGRRLTIVLANVLFLAGPLVMALAGGYGALMVGRFIAGIAVGYDFVIAPIYAAEISPASSRGLLTSVPEIFNNTGVMLSYVSNLAFSGLPPHLAWRVMFAAGAVPPVFLAAGTLTMPESPRWLVMKGRVTEAKSVLHRTSDTPAEAERRLLEIEDVVSGGGQGNGSSSSAWKEAAAKPGVRRVLAMVLTLQFFQQASGIDSVVLYGPRILAAAGVASNTSLLSLNILFGVAKAGSVLIAMALVDRAGRRPLLLASTGGMAASLLLVGSLFAAASAGGTELGGAAAVSAASVAAVVAYVVFFSMGLGPMAWVYSSEILPLRLRGQGAGLGTAMNRTMCAVVIMTFITLYKAVTMAGAFYLYAAISAAAFVFVYACLPETRGRSLEDMEELFHTK

SEQ ID NO: 4467 - protein, 310 aa, Zea mays
MAGGGAGDDDVVVVSCGGRGGGDPGAYAAVLKRKLDLYCAAVAKSMEAKSQEHSLGYPNSQASDASQLISQASFDGDIDGASLVTNSNVIEDDDFQGKPTNSGTSKELSDDDGDLEENTDPANAKKMRRMVSNRESARRSRKRKQAHLTDLESQVSRLTSENASLLKRLADMTQKYKDASVDNKNLTVDVETMRRKVNIAEEAVRRLTGITLMLPTAFEKPTSSAPLSSCPSDAASASASAAIEDSVKHFLQAPLENSGIIPNAAVFQTKPASLHRVASLENLQKRIVGDAMYSETASTTFSDPEALADR

SEQ ID NO: 4468 - protein, 383 aa, Setaria italica
MRIKTKGHFRKSPTVSPLAHWRPSNAAGINAASPPVSTIAQVAPSSLPSPSGPHRGTRCEKESDFPPSMAGGCAEDDVVEVSCGGGGRDPGAYAAVLKRRLDLYCAAVAKSMEAKSQESSLGYPNTQASNTSQLISQASFDDDGDGADLVTNSNIIDYDDFRGKPANSGTSKEQSDDDGDLEENTDPTNTKKMRRMLSNRESARRSRKRKQEHLTDLESQVSRLTSENASLLKRLADMTQKYKDATLDNRNLIVDVETMRRKVNIAEEAVRRLTGTTLLLPTTSDKPASSMRLTSCASDAASASVAIEDSMEHFLRAPFQDSQTKLDLQNAEIPLASGEIGTKLAPMRRVASLENLQKRMHGDSLHSETASTFSSDPESFAHR

SEQ ID NO: 4469 - protein, 361 aa, Zea mays
MAPPYVLSLLLLLVLSVPAVFLVAPRLIPPRALPAIPDADETEDLALFRRAVLLSAAPSSKAGAGPASPSRFFGAAHRRQRKQKVAFLFLTNSDLVFAPLWERFFAGHHGLLNVYVHADPAAAFALPPTPSFRGRVIRGKATQRASATLISAARRLLATALLDDPANHFFAMLSQSCVPLRPFPALYRTLTADTAGPRGRHRSFIEILDAEPTLHDRYYARGDDAMLPEVPYESFRVGSQFFVLTRRHAVMVVRDRRLWNKFKLPCLVKRKHSCYPEEHYFPTLLDMQDPAGCTKFTLTRVNWTDSFDGHPHTYQPEEVSPELIRDLRKSNGTYSHMFARKFAPGCLAPLMEIADSVILRD

SEQ ID NO: 4470 - protein, 369 aa, Panicum virgatum
MASPYAASPYVLSLLLLLLSIPAVFLLAPRLIPPRTLPAIPDADETEDLALFRRAVLLSAAPSSSKPADAATPSFFGGAAGFRKRKKKQQPKVAFLFLTNSDLVFAPLWEKFFEGHHGLLNVYVHADPAAALALPPTPSFWGRIIPGKATQRASATLISAARRLLATALLDDPANHFFALLSQSCVPLHPFPALYRTLTGDIAGPKGRHRSFIEILDAEPTLHDRYYARGDDIMLPEVPYDSFRVGSQFFVLTRRHAVTVVRDRRLWNKFKLPCLVKRKYSCYPEEHYFPTLLDMQDPSGSTKFTLTRVNWTDSFDGHPHTYQPEEVSGELIRELRKSNGTYSHMFARKFAPESLGLLMKIADSVILRD

SEQ ID NO: 4471 - protein, 372 aa, Setaria italica
MATPHAASPYVLSLLLLLLSIPAVFLLAPRLIPPRTLPAIPDADETEDLALFRRAVLLSAAPASKAAATAADPAGAATTSFFGGYGRKKKRQQPKVAFLFLTNSDLVFAPLWEKFFAGHHGLLNVYVHADPAAALTSPPTPSFRGRIIPGKATQRASATLISAARRLLATALLDDPANHFFALLSQSCVPLHPFPSLYRTLTGDNGGPKGRHRSFIEILDAEPTLHDRYYARGDDVMLPEVPYDSFRVGSQFFVLTRRHAVMVVRDRRLWNKFKMPCLVKRKYSCYPEEHYFPTLLDMQDPGGSTKFTLTRVNWTDSSDGHPHTYQPEEVSGELIRELRKSNGTYSHMFARKFAPECLGPLMKIADSVILRD

SEQ ID NO: 4472 - protein, 356 aa, Hordeum vulgare
MAYASPYVLSFLLLLSIPAVYFLAPRLLLPKTLPAIPDADETEDLALFRRAVLLSAAPGAPVAAAFCRRPQARPKVAFLFLTNSDLVFAPLWEKFFAGHHGLLNVYVHADPAANLTLPPTPSFRGRIIRGKATARASATLISAARRLLATALLDDPANHFFALLSQSCVPLLPFPALYRTLVTDNNAAGAGRHRRHRSFIEILDSEPTLHARYYARGDNVMLPEVPFDRFRVGSQFFVLARRHAVMVVRDRRLWNKFKAPCLVKEKDSCYPEEHYFPTLLDMQDPDGCTKYTLTRVNWTDAVDGHPHTYQPEEVSGDLIRELRKSNGTYSHMFARKFAAGTLAPLMEIADSVILRD

SEQ ID NO: 4473 - protein, 357 aa, Secale cereale
MAYASPYVLSFLLLLSIPAVYYLAPRLLLPKTLPAIPDADETEDLALFRRAVLLSAAPGAPGAGAFGRRPPQPRPKVAFLFLTNSDLVFAPLWEKFFAGHHGLLNLYVHADPAANLTLPPTPSFRGRIIRGKATARASATLISAARRLLATALLDDPANHFFALLSQSCVPLLPFPALYRTLLTDSNAAGAGRHRRHRSFIEILDSEPTLHARYYARGDNVMLPEVPFDRFRVGSQFFVLARRHAVMVVRDRRLWNKFKAPCLVKEKDSCYPEEHYFPTLLDMQDPDGCTKYTLTRVNWTDAVGGHPHTYQPEEVSGDLIRELRKSNGTYSHMFARKFAPETLAPLMEIADSVILRD

SEQ ID NO: 4474 - protein, 361 aa, Brachypodium distachyon
MAPPYTSPYVLSSLLLLLSIPAVVLLAPRLLLPRTLPAIPDADESDDLALFRRAVLLSSSGSGAGGAGGFVVRGRPQPKVAFLFLTNSDLVFAPLWEKFFAGHHGLLNLYVHADPSAVLASPPTPSFRGRFISGGKATARASATLISAARRLLATALLDDPANHFFALLSQSCVPLHPFPTLYRTLLSDNNNAGAGHRRRHRSFIEILDSEPTLHDRYYARGDNVMLPEVPFDAFRVGSQFFVLARRHAVMVVRDRRLWNKFKVPCLVKEKDSCYPEEHYFPTLLDMQDPDGCTKYTLTRVNWTDAVDGHPHTYQPEEVSGELIGELRKSNGTYSHMFARKFAPECLGPLMEIADSVILRD

SEQ ID NO: 4475 - protein, 356 aa, Avena sativa
MAPPYASPYALSFLLLLLSVPAVFFLAPRLLLPRTLPAIPDADETEDLALFRRAVLLSAAPAASGSLFGRRPQVQPKVAFLFLTNSDIVFAPLWEKFFAGHHGLLNLYVHADPSAVLTAPPTPSFRGRIIRGKATARASATLISAARRLLATALPDDPANQFFALLSQSCVPLHPFPTLYRTLVTDNNAGPGRHRHRSFIEILDSESTLPARYNARGNDVMLPEVPFDRFRVGSQFFVLARRHALMVVRDRRLWNKFKAPCLVKEKDSCYPEEHYFPTLLDMQDPEGCTKYTLTRVNWTDVVDGHPHTYQPEEVSGELIRELRKSNGTYSHMFARKFASATLGPLMEIADSVILRD

SEQ ID NO: 4476 - protein, 349 aa, Panicum virgatum
MASPYAASPYALSLLLLLLSIPAVFLLAPRLIPPRTLPAIPDADETEDLALFRRAVLLSAAPSSSKPAGAATPSFFRGAGGFLNNKRKKQKQQPKVAFLFLTNSDLVFAPLWEKLFAGHHGLLNVYVHADPAAALALPPTPSFRGRIIPGKATQRASATLISASRRLLATALLDDPANHFFALLSQSCVPLHPFPALYRTLTADIAGPKGRHRSFIEILDAEPTLHDRYYARGDDVMLPEVPYDSFRVGSQFFVLTRRHAVMVVRDRRLWNKFKLPCLVKRKYSCYPEEHYFPTLLDMQDPGGSTKFTLTRVNWTDSFDGHPHTYQPEEVSGELIRELRKSNAPTRYMF

SEQ ID NO: 4477 - protein, 365 aa, Oryza sativa
MALPHAASPYVLSLLLLLSIPAVFLLAPRLLPPKTLPSIPDADETDDLALFRRAVLLSAAPDSSSASAGAASLFGRRPQPKVAFLFLTNSDLVFSPLWEKYFAGNHHLLNLYIHADPSAAVDLPATASFRGHVIRGTKATARASATLISAARRLLATALLDDPSNHFFALLSQSCIPLHPFPTFYRTLLSDSDNNGGSPRRPRRRRSFIEILDNEPTLHDRYYARGDDVMLPEVPYDSFRVGSQFFVLVRRHAVMVVRDRRLWNKFKLPCLTKRKDSCYPEEHYFPTLLDMQDPQGCTKFTLTRVNWTDSVDGHPHTYRPDEVSGELIRELRKSNGTHSYMFARKFAPDCLKPLMEIADSVILRD

SEQ ID NO: 4478 - protein, 260 aa, Setaria italica
MGRSPCCEKAHTNKGAWTKEEDERLVAYIRAHGEGCWRSLPKAAGLLRCGKSCRLRWMNYLRPDLKRGNFTDEEDELIIRLHALLGNKWSLIAGQLPGRTDNEIKNYWNTHIKRKLLARGIDPQTHRPLGAGGAGADAAAATGIAAHRAAALLHPAAAAPASPVALAVIKPAPAESSDDGGRSSSSSGGASTGEPRCPDLNLDLSVGLPAADTPTSQPQPVVCLCYRLGLRAGEACGCQADKPGPQGFRYFRPLEQGQYI

SEQ ID NO: 4479 - protein, 252 aa, Saccharum officinarum
MGRSPCCEKAHTNKGAWTKEEDERLVAYIRAHGEGCWRPLPKAAGLLRCGKSCRLRWMNYLRPDLKRGNFTDDEDELIIRLHSLLGNKWSLIAGQLPGRTDNEIKNYWNTHIKRKLLARGIDPQTHRALGADAATAPGVAAHHRATAAALLHHAGAAVVVVPAPVKLAAVKPAPAESSSDDGGSSSGSSSGGGAGEPRCPDLNLDLSVGPPAVVADTPTLHLAVCLGYRLCLRPGRFAVTMLKLYCVSIWFY

SEQ ID NO: 4480 - protein, 258 aa, Zea mays
MAAPIHARLLPLPLHPNPSPSLHASGTRRVPWPPRHRRRCLATPPSRNGSSSSPEIDWCPVPPDQLPVNEYEALAASLPFSWAAGGLRVYCSRLALTGAAVALFVGLPVAAFGGRGGAGGDALHLALGATGSGILAVTLAVVRMYLGWAYVGNRLLSATVEYEETGWYDGQIWVKTPEVLARDRLLGSFSVKPVLNRVKFTLVGLAGSLILCILLYVNTETPKEPYGNTGGRSIPGVYSDAAARSFEPDAFCGEPDLS

SEQ ID NO: 4481 - protein, 115 aa, Panicum virgatum
MYLGWAYVGNRLLSATVEYEETGWYDGQIWVKTPEVLARDRLLGSFSVKPVLNRVKFTLVGLAGSLILCILLYVNTENPKEPYENTGGRAIPGVYSDTAARSFEPDAFCGEPDLS

SEQ ID NO: 4482 - protein, 263 aa, Setaria italica
MAASFSSPPLHARLLPLPPPQNPCPAVPASGARRAARPRPPRQRCLATPPSRNGSFSSPDTEWCPVPPEQRPVNEYEALASSLPFSWAAGDLRVYCSRLALTGAAFALFVGLPVAAFGGRGGAGGDAVHLALGATGSGILAVTLAVVRMYLGWAYVGNRLLSATVEYEETGWYDGQIWVKTPEVLARDRLLGSFSVKPVLNRVKFTLVGLAGSLILCILLYVNTENPKEPYENTGGGAIPGVYSDAAARSFEPDAFCGEPDLS

SEQ ID NO: 4483 - protein, 268 aa, Panicum virgatum
LPFPMAASLPSPPLHARLLPLPLLRNPGSALPARGARRVARPRPPRHRCLAMPPPSRNGSSSSPETEWCPVPPEQRPVNEYEALASSLPFSWAAGDLRVYCSRLALTGAAFALFVGLPVAAFGGRGGAGGDAVHLALGATGSGILAVTLAVVRMYLGWAYVGNRLLSATVEYEETGWYDGQIWVKTPEVLARDRLLGSFSVKPVLSRVKFTLVGLAGSLILCILLYVNTENPKQPYENTGGRAIPGVYSDTAARSFEPDAFCGEPDLS

SEQ ID NO: 4484 - protein, 258 aa, Triticum aestivum
MAASPSLHAPRLLHLLPKPAPTLGRPRRRRLATAPASAVPPSRNGSSAGTDWCPVPPEQRPVNEYEALAASLPFSWAAGDLRLYCSRLAFTGAAFALFVGLPVAAFGGRGGAGGDALHLALGATGSGILAVTLAVVRMYLGWAYVGNRLLSATVEYEETGWYDGQIWVKTPEVLARDRLLGSFSVKPVLNRVKFTLVGLAVSLTLCILLYANTEKPREPLENPAGGRAIPGVYSDAAARSFEPDAFCGEPDLGGGDQS

SEQ ID NO: 4485 - protein, 252 aa, Avena sativa
MASSLHGPRLLPLLPNPTPSLGRPRRGQRRRFAQVAAVPPSRNGSSAGTDWCPVPPEQRPVNEYEALAASLPFSWAAGDLQVYCSRLAFTGAAFAIFVGLPVAAFGGRGDAVHLALGATGSGILAVTLAVVRMYLGWAYVGNRLLSATVEYEETGWYDGQIWVKTPEVLARDRLLGSFSVKPVLNRVKFTLVGLAVSLTLCILLYANTEKPKEPYESTTGSARAIPGVYSDSAARSFEPDAFCGEPDLGDQS

SEQ ID NO: 4486 - protein, 259 aa, Brachypodium distachyon
MAASPSLHAPRLLPLLPNTPTPIPPAASVCPPRRSPRPRRRFAVPPSRNGSSAGTDWCPVPPEQRPVNEYEALAASLPFSWAAGDLRLYCSRLAVTGAAFALFVGLPVAAFGSHGVSGDGVHLALGATGSGIIAVTLAVVRMYLGWAYVGNRLLSATVEYEETGWYDGQIWVKTPEVLARDRLLGSFSVKPVLNRVKFTLVGLAVSLTLCIILYVNTEKPKEPFENTSGRAIPGVYSDTAARSFEPDAFCGEPDIGDQS

SEQ ID NO: 4487 - protein, 261 aa, Oryza sativa
MAAAPLSPPPPLHARLLLLPPLLPTMAGGSRGRRRGRGRRRFAVPPSRNGSSSQGTEWCPVPPEQLPVNEYESLAASLPFSWAAGDLTVYCSRLALTGAAFALFVGLPVASFGGRGGAGGDAVHLALGATGSGILAVTLAVVRMYLGWAYVGNRLLSATVEYEETGWYDGQIWVKTPEVLARDRLLGSFSVKPVLNRVKFTLVGLAVSLILCILLYANTENPKDPFENTVGRAIPGVYDDTSARSFEPDAFCGEPDLGDLS

SEQ ID NO: 4488 - protein, 722 aa, Zea mays
MDTAFLSPPLARNLVYDEFAVLHPTSYPFHTLRYLRCNPMYSRPLLTIAPASPSRGLIQRVAALPDVDDFFWEKDPTPILDTIDAPIHLKNLSSKELKQLADEVRSEIAFIMSRKCQPCGADRSVVELTIAIHYVFNAPMDKILWDAGQHAYAHKILTGRRSLFHTITQKNGLSGFTSRFESEYDPFGAGHGCNSLSAGLGMAVARDINGRKNRIVTVISNWTTMAGQVYEAMGHAGFLDSNMVVILNDSCHTLLPKADGGAKMSVNAFSSALSKIQSSKGFRRFREAAKGLAKWFGKGMHEFAAKVDEYARGMIGPHGATLFEELGLYYIGPIDGRNIDDLICVLKEVASLDSTGPVLVHVITGTENDTGGIIGSEINAVEEGPSNSSPDLLKFLGTGLSRTYNDCFVEALTAEAENDKRIVVVHGGMGIDRSLRLFQSRFPDRFFDLGIAEQHAVTFSAGLACGGLKPFCIIPSTFLQRAYDQIIEDVDMQKIPVRFAITNAGLVGSEGPTNSGPFDITFMSCLPNMIVMSPSNEDELIDMVATAAMIEDRPICFRYPRGAIVGTSGSVTYGNPFEIGKGEILVEGKEIAFLGYGEVVQRCLIARSLLSNFGIQATVANARFCKPLDIDLIRTLCQQHSFLITVEEGTVGGFGSHVSQFISLDGLLDGRTKWRPIVLPDRYIEHASLAEQLDLAGLTAHHIAATALTLLGRHRDALLLMK

SEQ ID NO: 4489 - protein, 721 aa, Setaria italica
MDTAFLRSPLARNLVYDEFAVLHSTSYRFHPLRYLRCNPTDSRPCQTLSASPLRGVTQRVAALPDVDDFFWEKDPTPILDTIDAPIHLKNLSSKELKQLADEVRSEISFIMSRKCQPCGPGRSVVELTIAIHYVFNAPMDKILWDAGQHAYAHKILTGRRSLFHTIKQKNGLSGFTSRFESEYDPFGAGHGCNSLSAGLGMAVARDINGRKNRIVTVISNWTTMAGQVYEAMGHAGFLDSNMVVILNDSCHSLLPKADDRPKMSVNAFSSALSKIQSSKGFRRFREAAKGLAKWFGKGMHEFAAKVDEYARGMIGPHGATLFEELGLYYIGPIDGHNIDDLICVLKEVATLDSTGPVLVHVITGTENDTGGNISSEITPNEEGPSNSSHDLLKFLETGLSRTYNDCFVEALTAEAENDKCIVVVHGGMGMDRSLRLFQSSFPDRFFDLGIAEQHAVTFSAGLACGGLKPFCIIPSTFLQRAYDQIVEDVDMQKIPVRFAITNAGLVGSEGPTNSGPFDITFMSCLPNMIVMSPSNEDELVDMVATAAMVEDRPICIRYPRGAIVGTSGTLTYGNPLQIGKGEILVEGKEIAFLGYGEVVQRCLIARSLLSNFGIQATVANARFCKPLDIDLIRTLCQHHSFLITVEEGTVGGFGSHVSQFISLDGLLDGRIKWRPIVLPDRYIEHASLAEQLDLAGLTAHHIAATALTLLGRHRDALLLMK

SEQ ID NO: 4490 - protein, 706 aa, Panicum virgatum
MTSLPCFTPQATVSILCGIPGRNPTNSTPCQTLSASPSRGLTQRVAALPNVDDFFWEKDPTPILDTIDAPIHLKNLSSKELKQLADEVHSEISFIMSRKCQPCGPGRSVVELTIAIHYVFNAPMDKILWDAGQHAYAHKILTGRRSLFHTIQQKNGLSGFTSRFESEYDPFGAGHGCNSLSAGLGMAVARDVNGRKNRIVTVISNWTTMAGQVYEAMGHAGFLDSNMVVILNDSCHSLLPKADGQPKMSVNAFSSAVSKIQSSKGFRRFREAAKGLTKWFGKGMHEFAAKVDEYARGMIGPHGATLFEELGLYYIGPIDGHNIDDLICVLKEVATLDSTGPVLVHVITGTEIDTGGNIRSEITPNDEGPPNSSHDLLNFLETGLSRTYNDCFVEALTAEAENDKRIVVVHGGMGMDRSLRLFQSRFPDRFFDLGIAEQHAVTFSAGLACGGLKPFCIIPSTFLQRAYDQIVEDVDMQKIPVRFAITNAGLVGSEGPTNSGPFDITFMSCLPNMIVMSPSNEDELIDMVATAAMVEDRPICFRYPRGAIVGTSGTLTYGNPLQIGKGEILVEGKEIAFLGYGEVVQRCLIARSLLSNFGIQATVANARFCKPLDLDLIRTLCQQHSFLITVEEGTVGGFGSHVSQFISLDGLLDGRIKWRPIVLPDRYIEHASLAEQLDLAGLTAHHIAATALTLLGRHRDALLLMK

SEQ ID NO: 4491 - protein, 722 aa, Oryza sativa
MGGRYLHSPPAVNLICEESTFVRSTSCCLHSCLCLRCKTSNLKPCRTLVFNMPSRRFNRRVAALPDVDDFFWEKDPTPILDTIDAPIHLKNLSSKELKQLAGEVRSEISFIMSRKCQPCNTGHSVVELAIAIHYVFNAPMDKILWDAGQHTYAHKILTGRRSLFHTIKQRKGLSGFTSRFESEYDPFGAGHGCNSLSAGLGMAVARDLGGRKNRIVTVISNWTTMAGQVYEAMGHAGFLDSNMVVILNDSRHTLLPKADSQSKMSINALSSALSKVQSSKGFRKFREAAKGLSKWFGKGMHEFAAKIDEYARGMIGPHGATLFEELGLYYIGPIDGNNIDDLICVLKEVSTLDSTGPVLVHVITENEKDSGGEFNSEITPDEEGPPDSSQDILKFLENGLSRTYNDCFVESLIAEAENDKHIVVVHGGMGIDRSIQLFQSRFPDRFFDLGIAEQHAVTFSAGLACGGLKPFCIIPSTFLQRAYDQIVEDVDMQKIPVRFAITSAGLVGSEGPTNSGPFDITFMSCLPNMIVMSPSNEDELIDMVATAAMVEDRPICFRYPKGAIVGTSGTLAYGNPLEIGKGEILAEGKEIAFLGYGDVVQRCLIARSLLFNFGIQATVANARFCKPLDIDLIRMLCQQHDFLITVEEGTVGGFGSHVSQFISLDGLLDGKIKWRPIVLPDRYIEHASLTEQLDMAGLTAHHIAATALTLLGRHRDALLLMK

SEQ ID NO: 4492 - protein, 511 aa, Zea mays
MTGAAAPAAPPRGGASASQPHAAAPAGKRAGCEPVRKAGPVTMEHVLLALHETEAEREARIRDMFAFFDTAGSGQLDYAQIEAGLAALQVPAECKYARELLRACDRDRDGRVGYDDFRRYMDDKELELYRIFQAIDVEHNGCILPEELWDALIKAGIEINDEELARFVEHVDKDNNGIITFEEWRDFLLLYPNEATIENIYHHWERVCLVDIGEQAAIPEGISKHVNASKYLIAGGIAGAASRTATAPLDRLKVIMQVQTTRTSVMHAIKDIWTKGGMLGFFRGNGLNVVKVAPESAIRFYAYEMLKEYIMKRKGENKSEVGASERLIAGGLAGAVAQTAIYPIELVKTRLQTYSGEVGYVPRIGQLSRDILVHEGPRAFYRGLVPSLLGIVPYAGIDLAVYETLKDVSKTYILKDSDPGPLVQLGCGTVSGALGATCVYPLQVIRTRLQAQQANSESAYRGMSDVFWRTLHHEGVSGFYKGILPNLLKVVPAASITYLVYEAMKKNLSLD

SEQ ID NO: 4493 - protein, 514 aa, Panicum virgatum
MTGAAAHAVEPRGGASAPQPPAAATAAAAKGAGGREPARKAAPVTMEHVLLALHETEAEREARIRDMFAFFDAAGRGQLDYAQIEAGLAALQVPAECKYARELLRACDRDRDGRVGYDDFRRYMDDKELELYRIFQAIDVEHNGCILPEELWDALVKAGIEINDEELARFVEHVDKDNNGIITFEEWRDFLLLYPNEATIENIYHHWERVCLVDIGEQAAIPEGISKHVNASKYLIAGGIAGAASRTATAPLDRLKVIMQVQTTRTTVMHAIKDIWDKGGMLGFFRGNGLNVVKVAPESAIRFYTYEMLKEYIMKSKGENKSEVGASERLVAGGLAGAVSQTAIYPIDLVKTRLQTYSCEGGKVPRIGALSRDIWMHEGPRAFYRGLVPSLLGIIPYAGIDLAVYETLKDVSKTYILKDSDPGPLVQLGCGTVSGALGATCVYPLQVIRTRLQAQQANSESAYRGMSDVFWRTLQHEGISGFYKGILPNLLKVVPAASITYLVYEAMKKNLSLD

SEQ ID NO: 4494 - protein, 521 aa, Setaria italica
MTGAAAHAVDPRGGASPPHPPAAATAAAAAAAKGAGGGAGGREPARKAAPVTMEHVLLALHETEAERESRIRDMFAFFDATGRGQLDYAQIEAGLAALQVPAECKYARELLRACDRDRDGRVGYDDFRRYMDDKELELYRIFQAIDVEHNGCILPEELWDALIKAGIEINDEELARFVEHVDKDNNGIITFEEWRDFLLLYPNEVTIENIYHHWERVCLVDIGEQAAIPEGISKHVNASKYLIAGGIAGAASRTATAPLDRLKVIMQVQTTRTTVMHAIKDIWAKGGMLGFFRGNGLNVVKVAPESAIRFYAYEMLKEYIMKSKGENKSEVGASERLIAGGLAGAVAQTAIYPIDLVKTRLQTYSCEGGKVPRIGALSRDILMHEGPRAFYRGLVPSLLGIVPYAGIDLAVYETLKDMSKTYILKDSDPGPLVQLGCGTVSGALGATCVYPLQVIRTRLQAQQANSEAAYRGMSDVFWRTLQHEGVSGFYKGIIPNLLKVVPAASITYLVYEAMKKNLSLD

SEQ ID NO: 4495 - protein, 515 aa, Oryza sativa
MPGAAVHAVDPRGGASPPPVAKAEAATAAAAAAGGCEPARKAGAVTMEHVLLALHETEAEREARIREMFAFFDVDGRGQLDYAQIEAGLAALQIPAECKYARELLRACDRDRDGRVGYDDFRRYMDDKELELYRIFQAIDVEHNGCILPEELWDALVKAGIEIDDEELARFVEHVDKDNNGIITFEEWRDFLLLYPNEVTIENIYHHWERVCLVDIGEQAVIPEGISKSVNASKYLIAGGIAGAASRTATAPLDRLKVIMQVQTTRTTVMHSIKDIWSQGGMLAFFRGNGLNVVKVAPESAIRFYAYEMLKEYIMKSKGENKSEVGPSERLVAGGLAGAVAQTAIYPVDLVKTRLQTYSCVDGKVPSLGALSRDILMHEGPRAFYRGLVPSLLGIVPYAGIDLAVYETLKDVSKTYILKDSDPGPLVQLGCGTVSGALGATCVYPLQVIRTRLQAQRANSESAYRGMSDVFWRTLQHEGVSGFYKGILPNLLKVVPAASITYLVYEAMKKNLSLD

SEQ ID NO: 4496 - protein, 515 aa, Brachypodium distachyon
MPGAAAHAVEPRGPAASPPPVAATAATATATAGGGCEPARKAGPVTMEHVLLALHETEAEREARIRDMFAFFDTSGRGQLDYAQIEAGLAALQVPAECKYARELLRACDRDRDGRVGYEDFRRYMDDKELELYRIFQAIDVEHNGCILPEELWDALVKAGIEIDDEELARFVEHVDKDNNGIITFEEWRDFLMLYPNEATIENIYHHWERVCLVDIGEQAAIPEGLSKHVSASKYLIAGGIAGAASRTATAPLDRLKVIMQVQTTRTTVAHAVKDIFIRGGLLGFFRGNGLNVVKVAPESAIRFYAYETLKEYIMNSKGENKSAVGASERLVAGGLAGAVAQTAIYPIDLVKTRLQTFSCVGGKVPSLGTLSRDIWMHEGPRAFYRGLVPSLLGIVPYAGIDLAVYETLKDASRTYILKDSDPGPLVQLGCGTVSGALGATCVYPLQVIRTRLQAQRANSESAYRGMSDVFWRTLQHEGISGFYKGILPNLLKVVPAASITYLVYEAMKKNLSLD

SEQ ID NO: 4497 - protein, 515 aa, Triticum aestivum
MPGAAAHAVEPRGTAAPSPPVAAAATAPAAAAGGPCEPVRKAGPVTMEHVLLALHETEEEREARIRDMFDFFDTSGRGQLDYAQIEAGLAALQVPAECKYARELLRACDRDRDGRVGYDDFRRYMDDKELELYRIFQAIDVEHNGCILPEELWDALVKAGIEIDDEELARFVEHVDKDNNGIITFEEWRDFLMLYPNEATIENIYHHWERVCLVDIGEQAAIPEGLSKHVSASKYLIAGGIAGAASRTATAPLDRLKVIMQVQTTRTTVTHAVKDIFIRGGLLGFFRGNGLNVVKVAPESAIRFYAYETLKEYIMNSKGENKSAVGASERLVAGGLAGAIAQTAIYPIDLVKTRLQTFSCESGKVPSLGTLSRDILKHEGPRAFYRGLVPSLLGIVPYAGIDLAVYETLKDASRTYIIKDTEPGPLVQLGCGTVSGALGATCVYPLQVIRTRLQAQQANSEAAYKGMSDVFWRTLRHEGVSGFYKGILPNLLKVVPAASITYLVYEAMKKNLSLD

SEQ ID NO: 4498 - protein, 491 aa, Panicum virgatum
GQGGGRARAGAEGGARDHGARPPRAPRDGGRAGGADPGHVRLLRRRGARAARLRADRGGPRRAAGARRVQVRPRAAPRLRPRPRRPRRLRRLPPLHGRQGARALPHLPGHRRRAQRLHPPRGALGRARQGCLLFAGIEINDEELARFVEHVDKDNNGIITFEEWRDFLLLYPNEATIENIYHHWERVCLVDIGEQAAIPEGISKHVNASKYLIAGGIAGAASRTATAPLDRLKVIMQVQTTRTTVMHAIKDIWAKGGMLGFFRGNGLNVVKVAPESAIRFYTYEMLKEYIMKSKGENKSEVGASERLVAGGLAGAVSQTAIYPIDLVKTRLQTYSCEGGKVPRIGALSRDIWMHEGPRAFYRGLVPSLLGIIPYAGIDLAVYETLKDVSKTYILKDSDPGPLVQLGCGTVSGALGATCVYPLQVIRTRLQAQQANSESAYRGMSDVFWRTLQHEGISGFYKGILPNLLKVVPAASITYLVYEAMKKNLSLD

SEQ ID NO: 4499 - protein, 473 aa, Pennisetum glaucum
MEHVRLALRETEAEREVRIRAVFASFDAAGRGHLDHAQIAAGLAALRVPEGGAGLEDYARALLRACDRDRDGRVGYEDFRRYMDDKELELYRIFQAIDVEHNGCILPEELWDALIKAGIEISDEELARFVEHVDKDNNGIITFEEWRDFLLLYPNEATIENIYHHWERVCLVDIGEQAAIPEGISKHVNASKYLIAGGIAGAASRTATAPLDRLKVIMQVQTTRTTVMHAIKDIWAKGGMLGFFRGNGLNVVKVAPESAIRFYAYEMLKEYIMKRKGENKSEVGASERLIAGGLAGAVAQTAIYPIDLVKTRLQTYSCEGGKVPRIGALSRDILMHEGPRAFYRGLVPSLLGIVPYAGIDLAVYETLKDVSKTYILKDGDPGPLVQLGCGTVSGALGATCVYPLQVIRTRLQAQQANSEAAYRGMSDVFWRTLQHEGVSGFYKGILPNLLKVVPAASITYLVYEAMKKNLSLD

SEQ ID NO: 4500 - protein, 446 aa, Secale cereale
MEHVLLALHETEAEREARIRDMFGFFDTSGRGQLDYAQIEAGLAALQVPAECKYARELLRACDRDRDGRVGYDDFRRYMDEKELELYRIFQAIDVEHNGCILPEELWDALVKAGIEIDDEELARFVEHVDKDNNGIITFEEWRDFLMLYPNEATIENIYHHWERVCLVDIGEQAAIPEGLSKHVSASKYLIAGGIAGAASRTATAPLDRLKVIMQVQTTRTTVTHAVKDIFIRGGLLGFFRGNGLNVVKVAPESAIRFYAYETLKEYIMNSKGENKSAVGASERLVAGGLAGAIAQTAIYPIDLVKTRLQTFSCESGKVPSLGTLSRDILKHEGPRAFYRGLVPSLLGIVPYAGIDLAVYETLKDASRTYIIKDTEPGPLVQLGCGTVSGALGATCVYPLQVIRTRLQAQQANSEAAYKGMSDVFWRTLRHEGVSGFYKGNPTEPP

SEQ ID NO: 4501 - protein, 528 aa, Sorghum bicolor
MSGAAVQAVEPRPAAAATTTTAASPAATAQPAAAARGAIGCGGAARASGPAAATMEHVLLALRETEAEREARIRGVFGFFDAAGRGHLDHAQIVAGLVALRVPEGTAGGAGAEDYARALLRACDRDRVGRVGYDDFRRYMDDKELELYRIFQAIDVEHNGCILPEELWHALVKAGIEIDDEELARFVEHVDKDNDGIITFEEWRDFLLLYPHEATIENIYHHWERVCLVDIGEQAAIPEGISKHVSASKYLIAGGIAGAASRTATAPLDRLKVNMQVQTNRTTVLDAVKGIWREGGLLGFFRGNGLNVVKVAPESAIRFYTYEMLKEYIMKSKGENKSDIGTSGRLMAGGLAGAIAQTAIYPIDLVKTRLQTYEGGKIPSLGALSRDIWIHEGPRAFYRGLVPSLLGMVPYAGIDLTVYETLKEMSKTYVLKDNDPGPLVQLGCGTVSGALGATCVYPLQVIRTRMQAQPANSEDPYRGMTDCFRRTLQREGVSGFYKGLVPNLLKVVPAASITYLVYETMKKSLSLD

SEQ ID NO: 4502 - protein, 516 aa, Oryza sativa
MSGAVATHAAEPPRPSAAAAEVAVAGGGGGCGAARKPAATMEHVLLALHETEAEREARIRAMFGFFDAAGRGHLDHAQIEAGLAALHLPPPPPPEEGGGGYARELLRACDRDRDGRVGYDDFRRYMDDKELELYRIFQAIDVEHNGCILPEELWHALVKAGIEIDDEELARFVEHVDKDNNGIITFEEWRDFLLLYPHEATIENIYHHWERVCLVDIGEQAAIPERISKHASASKYLIAGGVSGATSRTATAPLDRLKVIMQVQTNRITVLQAVKDIWREGSLRGFFRGNGLNVVKVAPESAIRFYAYEMLKEYIMKSKGENKSDIGTSGRLMAGGLAGAVAQTAIYPIDLVKTRLQTFACGSGKIPSLGALSRDIWMQEGPRAFYRGLVPSLLGMVPYAGIDLTVYETLKEMSKTYVLKDSDPGPLVQLGCGTVSGALGATCVYPLQVIRTRLQAQRANSEAAYRGMSDVFWKTLQHEGISGFYKGLVPNLLKVVPAASITYLVYETMKKSLSLD

SEQ ID NO: 4503 - protein, 478 aa, Panicum virgatum
MEHVRLALRETEAEREARIRAVFASFDAAGRGHLDHAQIAAGLAKLRVPAPEGEPGPGAGAEEDYARALLRACDRDRDGRVGYDDFQRYMDDKELELYRIFQAIDVEHNGCILPEELWHALVKAGIEIGDEELARFVEHVDKDNDGIITFEEWRDFLLLYPHEATIENIYHHWERVCLVDIGEQAAIPEGISKHVSASKYLIAGGIAGAASRTATAPLDRLKVNIQVQTNRTTVAHAVKSIWRDGGLVGFFRGNGLNVVKVAPESAIRFYTYEMLKEYIMKSKGEDKSDIGTSGRLMAGGLAGAVAQTAIYPIDLVKTRLQTYEGGRIPSLGALSRDIWIHEGPRAFYRGLVPSLLGMVPYAGIDLTVYETLKEMSKTYILKDSDPGPLVQLGCGTVSGALGATCVYPLQVIRTRMQAQSANSEDPYRGMTDCFRRTLRREGFSGFYKGLVPNLLKVVPAASITYLVYETMKKSLSLD

SEQ ID NO: 4504 - protein, 518 aa, Setaria italica
MSGAAVQAVEPRPAAAAGPAAAASQPAAGGGGGAAGQAATMEHVRLALRETEAEREARIRAVFASFDAAGRGHLDHAQIVAGLAALRVPAVPEGDAGSGAGLEDYARALLRACDRDRDGRVGYDDFRRYMDDKELELYRIFQAIDVEHNGCILPEELWHALVKAGIEIGDEELARFVEHVDKDNDGIITFEEWRDFLLLYPHEATIENIYHHWERVCLVDIGEQAAIPEGISKHVSASKYLTAGGIAGAASRTATAPLDRLKVNMQVQTNRTTVAHAVKGIWREGGLLGFFRGNGLNVVKVAPESAIRFYTYEMLKEYIMKSKGENKSDIGTSGRLIAGGLAGAVAQTAIYPIDLVKTRLQTYEGGRIPSLGALSRDIWIREGPRAFYRGLVPSLLGMVPYAGIDLTVYETLKEMSKTYVLKDSDPGPLVQLGCGTVSGALGATCVYPLQVVRTRMQAQSANSEDPYRGMTDCFRRTLRREGISGFYKGLVPNLLKVVPAASITYLVYETMKKSLSLD

SEQ ID NO: 4505 - protein, 291 aa, Saccharum officinarum
MKKCASELQLEAFIRESGDDARAAAGRSNPGCGGPGEPGGSGVFSPGAGGALPGVGFADSNTMDESSWWYGSVRTPNPDMSRTASISASLGAATSANHALESESDSDSESLYEVEGVPYERGNKSIETKRIRRMVSNRESARRSRRRKQAQLSELESQVERLKGENETLFQQLSEANQQFSTAVTDNRILKSDVEALRVKVKMAEDMVARSAISCGLGDLGLAPYLNSRKMCEALNMLTTTGLDLLGSDAFRGPTAAPQVQNSPVQSTASLETLDNRKSNEVTSCAADIWP

SEQ ID NO: 4506 - protein, 282 aa, Zea mays
MKKCASELELEAFIRESGEDARAAAGGSSPGCGGSSDPGGSGVFSPGFGFADSDTMDGGSWWYGNVRTPNPVMSQAASISASPGLTTSANHALESESDSDSESLYEVEGVPYERGNRSIETKRIRRMVSNRESARRSRRRKQAQLSDLESQVERLKGENATLFQQLSDANQQFSTAVTDNRILKSDVEALRIKVKMAEDMVARSAVSCGLGDLGLAPYVNSRKMCQALNVLTGLDLLGSDAFRGPTAGTRVQNSPVQSTASLESLDNRKSNEVTSCAADIWP

SEQ ID NO: 4507 - protein, 280 aa, Panicum virgatum
MKKCPSELQLEAFIRESGAGAAESKPGSGPSEPGGSGVFSPGGVGFGDSNTMDGSSWWYGSIRPANPVASQTASVSASPRATTPANHTLESESDSDSESLYEVEGGSCERGTKSMETKRIRRMVSNRESARRSRRRKQAQLSELESQVEQLKGENATLFKQLSEANQQFTTAVTDNRILKSDVEALRVKVKMAEDMVARSAMSCGLGDLGLAPYLNSRKLGQALNMLTVTGLDLLGSEAFRGPTAARQVQNSPVQSTASLESLDNRKSSEVTSCAADMWP

SEQ ID NO: 4508 - protein, 285 aa, Setaria italica
MKKCPSELQLEAFIRESGEGAVSGAAESKPSGSGPSEPGGSGVFSPGGIGFGDTSAMDGNSWWFGSIRPANPVASQTASISASPRATTSANHALESESDSDSESLYEVEGGSCERGTKSMETKRIRRMVSNRESARRSRRRKQAQLSELESQVEQLKGENATLFKQLSEANQQFTTAVTDNRILKSDVEALRVKVKMAEDMVARSAMSCGLGDLGLAPYLNSRKMCQALNMLTVTGLDLLGSDAFRGTTAARQVQNSPVQSTASLESLDNRKSSEVTSCAADMWP

SEQ ID NO: 4509 - protein, 353 aa, Panicum virgatum
AQHPATSSLSTYPPPDSRPLQKPPARRRHGRKTTPPVQPRRSQEGSSRGKRARPAPAANGAPADGDEEVPVGAAAGGVHPGKRRRRGEQARNRTQRARRERRVLARRERRVSPGGVGFGDSNTMDGSSWWYGSIRPANPVVSQTASVSAASPRATTSANHALESESDSDSESLYEVEGGSCERGTKSMETKRIRRMVSNRESARRSRRRKQAQLSELESQVEQLKGENATLFKQLSEANLQFTTAVTDNRILKSDVEALRVKVKMAEDMVARSAMSCGLGDLGLAPYLNSRKMGQALNMLTATGLDLLGSEAFRGPTAARQVQNSPVQSTASLESLDNRKSSEVTSCAADMWP

SEQ ID NO: 4510 - protein, 826 aa, Setaria italica
MAQSKEEFLEQFGGDYGYPDAPRGIDELRAADFKRLEGMVYLDHAGAALYSEAQMANVAKDLMSNVYGNPHSQSDSSMATSDLVTSVRHQVLKYFNASPRDYKCIFTSGATAALKLVGECFPWSRESCYMYTMENHNSVLGIREYALSKGATVSAVDVEEVTDPSKNLGSDSLFNISKHSNQRRGDDVLLHNYQNGSLTAISGNNLNLFAFPSECNFSGHKFNLSLVKLIKERKFLSASQQQGRWMVLIDAAKGCTTEPPNLTVCPADFVVCSFYKIFGYPTGLGALIVKNEAASLLNKTYFSGGTVAASIADIDFVQKRKSIEQVLEDGTISFLSISSLRYGFEIIDMLTISAIARHTASLATYVRKKMMDLKHSNEKNVCIIYGQQASKVKDLKMGPTITFNLKREDGTWFGYREVEKLASLSGIHLRTGCFCNPGACAKYLGLSHSDLVSNFEAGHVCWDDNDIINGKPTGAVRISFGYMSTYEDAEEFLKFLQSSFVSKAVGLTNGYMVNMDIPNFVDDWSQQAISDIRLKSITIYPVKSCQGFSVQGWPLTIGGLKYDREWLLQGSGGEILTQKKVPELSSIRTLIDLELGKLFLESPKRKDKLQISVLENWTHLSAEVDVYGQRYEVQTYGDKVNFWFSDAIGRPCTFMRCLSSKYRSCTINGRRDRLCRDTQSKLSFVNEGQLLLVSEASITDLNSRLSSGNGNGKQRVFVDAMRFRPNIVVSGSTPYNEDNWKRLNIGEAYFTSMGGCNRCQMINLYQSSGQVIKSKEPLATLASYRRQKGKILFGILLNYEDSTDGEDETIVERWIKVGQEVYPSTE

SEQ ID NO: 4511 - protein, 814 aa, Panicum virgatum
MAQSKEEFLEQFGGDYGYPDAPRGIDELRAADFKRLEGMVYLDHAGATLYSEAQMADVAKDLMSNVYGNPHSQSDSSMATSDLVTSMRHLVLKYFNASPRDYKCIFTSGATAALKLVGECFPWSRDSCYMYTMENHNSVLGIREYALSKGATVSAVDIEEVVDPSKNQGCDSLFKISKRSNQRRGDDVLLHNYQNGSLTAISCNFSGHKFNLSLVKLIKEGKFIGTSQQQGRWMVLIDAAKGCTTEPPNLTVYPADFVVCSFYKIFGYPTGLGALIVKNEAAGLLNKTYFSGGTVAASIADIDYVQKRKSIENVLEDGTISFLSISSLRYGFKIIDMLTISAIARHTASLATYVRRKMMDLKHSNEKNVCIIYGQQASKVKDLKMGPTITFNLKREDCTWFGYREVEKLACLSGIHLRTGCFCNPGACAKYLGLSHSDLVSNFEAGHVCWDDNDIINGRPTGAVRISFGYMSTYEDAEEFLKFLQSSFVSKAVGLNNSYMVNMDTLNLVDDWSQQATSDIRLKSITIYPVKSCQGFSVQGWPLTTGGLKYDREWLLQGSGGEILTQKKVPELSSIRTLIDLELGKLFLESPKRKDKLQISVLENLTHISAEVDVYGQRYEVQTYGDKVNSWFSDAIGRPCTFMRCTSSKHRSCTINGRRDRLCRDTRSKLSFVNEGQLLLVSEESISDLNSRLSSGNVNGKQQMFVDAMRFRPNIVVSGSASYDEDNWKRLNIGEAYFTSMGGCNRCQMINLYQSSGQVIKSKEPLATLASYRRQKGKILFGILLNYEDSMYEEDDAVVERWIKVGQEVYPSTE

SEQ ID NO: 4512 - protein, 829 aa, Brachypodium distachyon
MDRSKEEFLEQFGADYGYPAAPRGVDEMRAADFKRLEGTVYLDHAGATLYSEAQMANVVKDLTSNVYGNPHSQSDSSMAATDLVTAARHQVLKYFNASPRDYKCIFTSGATAALKLVGECFPWSRESCYMYTMENHNSVLGIREYALRKGATVLAVDVEEDGDLENNHGSPSPSMFKISRHSNQRRGDNVLSHSCQNGSLSAISGNNWNLFAFPSECNFSGQKFNLNLVKLIKEGKIVELPSSQQGQWMVLIDAAKGCATEPPNLGVYPADFVVCSFYKIFGYPTGLGALIVKNEAASLLNKTYFSGGTVAASIADIDFAKQRKNIEQVLEDGTISFLSIASLRHGFKIIDMLTTSAIARHTASLATYVRKKMLEMKHNNKKNVCIIYGQQASKVADLKMSPTITFNLKREDGTWFGYREVEKLASLSGIHLRTGCFCNPGACAKYLGLSHSDLVSNFEAGHVCWDDNDVIKGKPTGAVRISFGYISTYQDAEEFLKFLESSFLSKPIASNNGYTLNMNMLNLVDNRSQQVVPDVRLKSIIIYPVKSCQGFSVQSWPLTTGGLKYDREWLLQGSGGEILTQKRVPELGSIRTLINLELGKLFVESPKRKDKLQISLLENLTHLTAEVDVYGQRYEVESYDDKVNTWFSEAIGRHCTFVRCSNSKKRSCTFAGKNGRLCRDTRSKLSFVNEGQLLLISEQSVSDLNSRLSSSNGNGKQQMLVDAMRFRPNIVISGSMPYDEDNWKELCIGEACFTSMGGCNRCQMINLHQSSGQVIKSKEPLATLASYRREKGKIMFGVLFNYEDGLDGEEETVAERWLQVGQEVHSSTW

SEQ ID NO: 4513 - protein, 830 aa, Secale cereale
HGAEQGGVLGAVRRRLRLPGAPRSVDEMRAADFKRLQGTCTWTMPARRSTRSRRWPMSSRTSPPMSMATLIARVTRAWPRPTKLLLRAIRYLKYFNASPRDYKCIFTSGATAALKLVGECFPWSRESCYMYTMENHNSVLGIREYALSKGATALAVDIEEDKGLEKNHGSPSSDLFKISRHSNQRRGGDVHSQNCQNGSLSAASENNWNLFAFPSECNFSGQKFNLNLVKLIKEGNLVGLPSPQQQGQWMVLIDAAKGCATEPPNLDVYPADFVVCSFYKIFGYPTGLGALIIKNEAASLLNKTYFSGGTVAASIADIDFVQKRKSIEQVLEDGTISFLSIASLRHGFKIIEMLTTSAIARHTSSLATYVRKKMLDMKHRNKKNVCIIYGQEASKVADLKTSPTITFNLKREDDTWFGYREVEKLASLSGIHLRTGCFCNPGACAKYLGLSHSDLVSNFEAGHVCWDDNDVIKGKPTGAVRISFGYISTYQDAEEFLKFLQSSFVSKPIASSNGHTLSMNTLNLVDNQSQQGVPDVRLKSIIIYPVKSCQGLSVQSWPLAAGGLKYDREWLLQGSGGEILTQKKVPELASIRTLINLELGKLFVESPKRKDKLQISLLENLTHLTAEVDVYGQRYEVESYDEKVNTWFSEAIGRHCSFMRCSSSRSSFCTSTGKNGRLCRDTRSKLSFVNEGQLLLISEESVSDLNSRLSSSNGNGKQHVLVDAMRFRPNIVISGSTPYREDNWKRLRIGDAYFTSMGGCNRCQMINLHQNAGQVIKSKEPLATLASYRREKGKILFGVLLSYEDGSSGEEEAVAERWLQVGQEVHASTE

SEQ ID NO: 4514 - protein, 337 aa, Secale cereale
MDQSREEFLEQFGGDYGYPDAARGVDQMRAADFKRLQGTVYLDHAGAALYSEPQMADVVKDLTSNVYGNPHSQSDSSMAATDQVTAARHQVLKYFNASPRDYKCIFTSGATAALKLVGECFPWSRESCYMYTMENHNSVLGIREYALSKGATALAVDIEEDKGLEKNHGRPSSDLFKISRRSNQRRVGDVHSQNCQNGSLSAASDNWNLFAFPSECNFSGQKFNLNLVKLIKEGNLVGLPSPQQQGQWMVLIDAAKGCATEPPNLDVYPADFVVCSFYKIFGYPTGLGALIIKNEAASLLNKTYFSGGTVAASIADIDFVQKEKALNKFLRMEQSRS

SEQ ID NO: 4515 - protein, 593 aa, Triticum aestivum
MDQSREEFLEQFGGDYGYPDAPRGVDQMRAADFKRLQGTVYLDHAGAALYSEPQMADVVKDLTSNFYGNPHSQSDSSMAATDQVTAARHQVLKYFNASPRDYKCIFTSGATAALKLVGECFPWSRESCYMYTMENHNSVLGIREYALSKGATALAVDIEEDKGLEKNHGSPSSGLFKISRHSNQRRGGDVLSQNCQNGSLSTVSENNWNLFAFPSECNFSGQKFNLNLVKLIKEGNLVGLPSQQQQGQWMVLIDAAKGCATEPPNLDVYPADFVVCSFYKIFGYPTGLGALIIKNEAASLLNKTYFSGGTVAASIADIDFVQKRKNIEQVLEDGTISFLSIASLRHGFKIIEMLTTSAIARHTSSLATYVRKKMLDMKHRNKKNVCIIYGLEPSKVADLKTSPTITFNLKREDGTWFGYREVEKLASLSGIHLRTGCFCNPGACAKYLGLSHSDLVSNFEAGHVCWDDNDVIKGKPTGAVRISFGYISTYQDAEEFLKFLQSSFVSKPIASSNGHALSMNTLNLVDNQSQQVVPDVRLKSIIIYPVKSCQGFSMQSWPLAAGGLKYDREWLLQGSGGEILTQKRYQSWPLSAH

SEQ ID NO: 4516 - protein, 824 aa, Oryza sativa
MEVSKEEFLRQFGGDYGYPGAPKGVDEMRAAEFKRLEGMAYLDHAGATLYSEAQMADVLKDLASNVYGNPHSQSDSSMAASDLVTAARHQVLKYFNASPREYKCIFTSGATAALKLVGECFPWSRESCYMYTMENHNSVLGIREYALSKGATVLAVDVEEGADLAKDNGSYSLYKISRRTNQRRSKDVLSHNCQNGSLSDISGNNWNIFAFPSECNFSGQKFSLSLVKLIKEGKIPLQQQGKWMVLIDAAKGCATEPPNLTVYPADFVVCSFYKIFGYPTGLGALIVKNEAANLLNKTYFSGGTVAASIADIDFVQKRKNIEQVLEDGTISFLNIASLRHGFKIIEMLTTSAIERHTTSLATYVRNKMLDLKHSNEINVCTIYGQQYSKVEGLKMGPTITFNLKREDGSWFGYREVEKLASLFGIHLRTGCFCNPGACAKYLGLSHSDLVSNFEAGHVCWDDNDIINGKPTGAVRISFGYMSTFEDAEKFLKFLQSSFVSLPVQFNNGYMLNLNSLNLIDNSSQKAVSDIHLKSIIIYPVKSCQGFSVKSWPLTTGGLMYDREWLLQGSGGEILTQKKVPELGSIRTLIDLELGKLFIESPTRRDKLQLSLLESLADLSEEVDVFGQRYEVQSYDDRVNTWFSEAIGRPCTLVRCSSSKYRSCTYTGLRDRPCRDTQSKLNFVNEGQLLLISEESISDLNSRLNSGKGDCKQKLPVDAMRFRPNLVISGSSPYSEDNWKKLRIGEACFTSMGGCNRCQMINLHQDSGQVLKSKEPLATLASYRRKKGKILFGILLNYEDIMEGENETIAGRWLQVGQQVYPSTE

SEQ ID NO: 4517 - protein, 675 aa, Zea mays
MGASHDDEAGPLASLLAARRALRAGLDKSRALSRALAPRLEGIQARLPAMEASVRPIRAPPEALATAGPNIDRAVGPAAAVLKVFDAVHGLEPPLLDRAAAAADLPGYLAVLAQLEAALRLLSDNCGLATQWLADIVAYLGERRLADARFVAGLAAALDRLRDDASAGLDAGLLAAALDMLQAEFRRLLKDHSAPLAMKDPDGSGSDPPPVVPSRIPAAVVHKLSLILDRLAANGRLDHCSSAYGDARGDTVCASLRALGLDYLKETSGDAQALSPSVERWARHLEFAVHHLLEAERKLCVAVFERRPEAAPLCFAEIAARAGILDFLDFGRALADARKDPIKLLRLLDVFHCLNKLRLDFNRLFGGKACVEIQSRTRELVKRVVDGAVEIFEELLVQVELQRTIPPPVDGGVPRLVSFVAKYCNQLLGEQYRSVLTQVITIHRSWRKEVFNDKMLVDAVLNIVKTLELNFDTWSKAYGDTTLSSLFMMNIHWHFFKHLKGTKLGELLGDPWLREHEQYKDYYSAMFLRESWGTLAPLLSREGLIMFSKGRATARDLVKQRLKSFNASFDEMFQKQSKWVISDRDLQQKTCHLVVQAVVPVYRSFMQNYGPLVEQDVSASRYVKYSAEDLDKMLNTLFLSKPGRPMRAGSFQIKNSNDKITSAMTGLYRSASTLK

SEQ ID NO: 4518 - protein, 686 aa, Setaria italica
MGAAADNQQQPEEAEEGRRMAALLAARQALRSGVERSRALGRALARESSPRLEEIQSRLPAMEASVRPIRAPAEALASAGGNIDRALGPAAAVLKVFDAVHGLEPTLLARDSLADDVPGYLAVLAQLEGALRLLADNCGLAAQWLADIVAYLGDRSLADPRFLSGLAGQLDNLKGRAAADLDAGLLAAALGMLEAEFRRLLAEHSAPLAMRERGDSSTPASIVPSRIPPSVVHKLSLILDRLAANGRLDRCSAAYADARGDTVGASLRALGLDYLKETSEDAQVLSPSVERWGRHLEFAVHHLLEAERKLCVAVFERRPEAMPSCFAEVAARAGILDFLKFGRALADTRKDPIKLLRLLDVFDALNKLRLDFNRLFGGKACAEIQTRTRELVKMVVDGAVEIFEELLVQVELQRNMPPPVDGGVPRLVSFVAKYCNQLLGEPYRSVLTQVVTIHRSWRKEVFNDKMLVDAVLNIVKTLEINFETWSKAYGDTTLSCLFMMNIHWHFFKHLKGTKLGELLGDAWLREHEQYKDYYSAVFLRESWGTLAPLLSREGLIMFSKGQATARDLVKQRLKSFNAKFDEMFQKQSTWVISDRDLQQKTCHLVVQAIVPIYRSFMQNYGPLVEQDISASKYVKYSAEDLDKMLNTLFLPKPGRPRRTGSFQIRHSGDKITSAMTGLYRSASTLK

SEQ ID NO: 4519 - protein, 274 aa, Glycine max
MSVIDILTRVDSICKKYDKYDVDKHRDANVSGDDAFARLYASVDADIEALLQKAESASKEKGKASAVAINAEIRRTKARLLEEVPKLQRLAVKKVKGLSSQEFAARNDLVLALPDRIQAIPDGAPPVPKQTGGWAASASRPEIKFDSDGRFDDEYFQQSEQSNQFRQEYEMRRMKQASNLKQLRVDQGLDVIAEGLDTLKNMAHDMNEELDRQVPLMDEIDTKVDKASSDLKNTNVRLKDTVNQLRSSRNFCIDIVLLIIILGIAAYLYNVLKK

SEQ ID NO: 4520 - protein, 265 aa, Glycine max
MSVIDILTRVDSICKKYDKYDVDKHRDANVSGDDAFARLYASVDADIEALLQKAESASKEKGKASAVAINAEIRRTKARLLEEVPKLQRLAVKKVKGLSSQEFAARNDLVLALPDRIQAIPDGAPPVPKQTGGWAASASRPEIKFDSDGRFDDEYFQQSEQSNQFRQEYEMRRMKQDQGLDVIAEGLDTLKNMAHDMNEELDRQVPLMDEIDTKVDKASSDLKNTNVRLKDTVNQLRSSRNFCIDIVLLIIILGIAAYLYNVLKK

SEQ ID NO: 4521 - protein, 265 aa, Vigna unguiculata
MSVIEILTRVDSICKKYDKYDVEKHRDANVAGDDAFARLYASVDADIEALLQKAETASKEKGKASAVAINAEIRRTKARLLEEVPKLQRLAVKKVKGLSSQEFAARNDLALSLPDRIQAIPDGSPPVPKQSGGWASSASRPEIKFDSDGQFDDDYFQQSEQSSQFRQEYEMRRMKQDQGLDVIAEGLDTLKNMAHDMNEELDRQVPLMDEIDTKVDKASSDLKNTNVRLKHTVNQLRSSRNFCIDIVLLIIILGIAAYLYNVLKK

SEQ ID NO: 4522 - protein, 265 aa, Cajanus cajan
MSVIDILTRVDSICKKYDKYDVEKQRDSNISGDDAFARLYASVDSDIEALIQKAETASKEKGKASAVAINAEIRRTKARLLEEVPKLQRLAVKKVKGLSSQEFAARNDLVLALPDRIQAIPDGTPPAPKQSGGWAASASRPEIKFDSDGRFDDEYFQQTEQSSQFRQEYEMRRIKQDQGLDVIAEGLDTLKNMAHDMNEEMDRQVPLMDEIDTKVDKASSDLKNTNVRLKDTVNQLRSSRNFCIDIVLLIIILGIAAYLYNVLKK

SEQ ID NO: 4523 - protein, 265 aa, Phaseolus vulgaris
MSVIDILTRVDSICKKYDKYDVEKHRDSNISGDDAFAKLYASVDADIEALLQKAETASKEKGKASAVAINAEIRRTKARLLEEVPKLQRLAVKKVKGLSSQEFAARNDLALTLPDRIQAIPDGSPAVPKQTGGWAASASRPEIKFDSDGQFDDEYFQPSEQANQFKQEFEMRRMKQDQGLDVIAEGLDTLKNMAHDMNEELDRQVPLMDEIDTKVDKASSDLKNTNVRLKDTVNQLRSSRNFCIDIVLLIIILGIAAYLYNVLKK

SEQ ID NO: 4524 - protein, 265 aa, Arachis hypogaea
MSVIDLLTRVDSICKKYDKYDVDRQKDANISGDDAFARLYAVVDADIEAALQKAEQASKEKGKASAVAINAEIRRTKARLLEEVPKLQRLAMKKVKGLSSQEFAARNDLVLALPERIQAIPDGTPAAPKQTGGWTASASRPEIKFDSDGRFDDEYFQQTEESSRFRQEYEMRRMKQDQGLDVIAEGLDTLKNMASDMNEELDRQVPLMDEIDTKVDKASSDLKNTNVRLKDTVMQLRSSRNFCIDIVLLIIILGIAAYLYNVLKK

SEQ ID NO: 4525 - protein, 265 aa, Cicer arietinum
MSVIDILTRVDSICKKYDKYDLEKNKDANVSGDDAFVRLYASVDSDIDSLLQKAETASKDRGKASAVAINAEIRRTKARLLEEVPKLQRLAIKKVKGLSSQEFAARNDLVLALPERIQAIPDGTPAAPKQTGGWAASASRAEIKFDSDGRFDDEYFQSTEQSSQFRQEYEMRRIRQDQGLDVIAEGLDTLKDMAHDMNEELDRQVPLMDEIDSKVDKASSDLKNTNVRLKHTVNQLRSSRNFCIDIVLLIIILGIAAYLYNVLKK

SEQ ID NO: 4526 - protein, 265 aa, Glycine max
MSVIDILTRVDSICKKYDKYDVEKQRDSNLSADDAFAKLYASVDADIEALLQKAETADKEKSKASTVAINAEIRRTKARLLEEVPKLQRLAMKKVKGLSSQEFAARNDLALALPDRIQAIPDGAPAAPKQTGSWAASASRPGIKFDSDGKFDDEYFQQTEESSRFRQEYEMRKMKQDQGLDMIAEGLDTLKNMAHDMNEELDRQVPLMDEIDTKVDRASSDLKNTNVRLRDTVNQLRSSRNFCIDIVLLIIILGIAAYLYNVLKK

SEQ ID NO: 4527 - protein, 265 aa, Cajanus cajan
MSVIDILTRVDSICQKYDKYDVAKQRDSNISADDAFAKLYASVDADIEALLQKAETAPKEKTKASTVAINAEIRRTKARLLEEVPKLQRLAMKKVKGLSSQEFAARNDLVLALPDRIQDIPDGTPAPPKRTGGWAASASRPGIKFDSDGRYDDEYFQQTEESSRFRQEYEMRKMKQDQGLDMIAEGLDTLKNMAHDMNEELDRQVPLMDEIDTKVDKASSDLKNTNVRLRDTVNQLRSSRNFCIDIVLLIIILGIAAYLYNVLKK

SEQ ID NO: 4528 - protein, 264 aa, Glycine max
MSVIDILTRVDSICKKYDKYDVEKQRDSNLSADDAFAKLYASVDADIEALLQKAETADKEKSKASTVAINAEIRRTKARLLEEVPKLQRLAMKKVKGLSSQEFAARNDLALALPDRIQAIPDGAPAAPKQTGSWAASASRPGIKFDSDGKFDDEYFQQTEESSRFRQEYEMRKMKQASLDMIAEGLDTLKNMAHDMNEELDRQVPLMDEIDTKVDRASSDLKNTNVRLRDTVNQLRSSRNFCIDIVLLIIILGIAAYLYNVLKK

SEQ ID NO: 4529 - protein, 265 aa, Medicago truncatula
MSVIDLLTRVDSICKKYDKYDLDKQNNANVSGDDAFVRLYASVDSDIEALLQKAEKASNERGKASAVAINAEIRRTKARLLEEVPKLQRLALKKVKGLESQEFAARNDLVLALPERIQAIPDGTPVAPKQTGGWASSASRPEIKFDSDGRFDDEYFQSTEQSNQFKQEYEMRRIKQDQGLDMIAEGLDTLKDMAHDMNEELDRQVPLMDEIDAKVDKASSDLKNTNVRLKDTVNQLRSSRNFCIDIVLLIIILGIAAYLYNVLKK

SEQ ID NO: 4530 - protein, 265 aa, Trigonella foenum-graecum
MSVIDLLTRVDSICKKYDKYDLDKQNNANVSGDDAFVRLYASVDSDIESLLQKAEKASNERGKASAVAINAEIRRTKARLLEEVPKLQRLALRKVKGLESQEFAARNDLVLALPERIQAIPDGTPVAPKQTGGWASSASRPEIKFDSDGRFDDEYFQSTEQSNQFKQEYEMRRIKQDQGLDMIAEGLDTLKDMAHDMNEELDRQVPLMDEIDTKVDKASSDLKNTNVRLKDTVNQLRSSRNFCIDIVLLIIILGIAAYLYNVLKK

SEQ ID NO: 4531 - protein, 265 aa, Glycine max
MSVIDILTRVDSICKKYDKYDVQSQRDSNLSSDDAFAKLYASVDADIEALLQKADTASKEKSKASTVAINAEIRRTKARLLEEVPKLQRLAMKKVKGLSSQEFAARNDLALALPDRIQAIPDGTPAASKQSGSWAASASRPGIKFDSDGKFDDEYFQQTEESSGFRKEYEMRKMKQDQGLDMIAEGLDTLKNMAHDMNEELDRQVPLMDEIDTKVDRASSDLKNTNVRLRDTVNQLRSSRNFCIDIVLLIIILGIAAYLYNVLKK

SEQ ID NO: 4532 - protein, 269 aa, Lotus japonicus
MSVIDLLTRVDTICNKYDKYDVERHRESNLSGDDAFARLYATVDADIEALNQKAETASKEKGKASAVAINAEIRRTKARLLEEVPKLQKLAVKKVKGLSSQEFAARNDLVLALPERIQAIPDGTPAAPKQTGGWASSGSRPDIKFDSDGRFDDEYFPQTEESSRFRNEYEMRRIKQASIFSSCLDVIAEGLDTLKDMAHDMNEELDRQVPLMDEIDTKVDQAASDLKNTNVRLKDTVIQLRSSRNFCIDIVLLIIILGIAAYLYNVLKK

SEQ ID NO: 4533 - protein, 273 aa, Populus trichocarpa
MSVIDILTRVDAICNKYDKYDVEKQKDLNVSGDDAFARLYAAVDADIEAALQKAELASKEKSKASAVAINAELRRTKARLLEEVPKLQRLAIKKVKGLSIEELAARNDLVHALPDRIQAIPDGSSAALKQTGGWGSSAPRTEIKFDSDGQFDNEYFQESETSSQFRQEYEMRKMKQARLIKWHSDQGLSMISEGLDTLKNMAHDMNEELDRQVPLMDEIDTKVDKAAADLKNTNVRLKDTVNQLRSSRNFCIDIVLLIIILGIAAYLYNVLKK

SEQ ID NO: 4534 - protein, 265 aa, Nicotiana benthamiana
MSVIDILTRVDSICKKYDRYDIDKQKDSNISGDDAFARLYAAVDADIEAALQKAETASKEKNRASAVAINAEIRRTKARLVEEVPKLQRLAMKKVKGLSSEEFAARNDLVLALPDRINAIPDGAAAAPKQSGGWGGSGSRAEIKFDSDGRFDDEYFQQTEEASQFRQEYEMRKMKQDQGLEVISEGLDTLKNMASDMNEELDRQVPLMDEIDTKIDKASSDLKNTNVRLKDTVNQLRSSRNFCIDIILLIIILGIAAYLYNVLKK

SEQ ID NO: 4535 - protein, 280 aa, Theobroma cacao
MSVIDILTRVDVICKRYDKYDVEKQRDQNVSGDDAFARLYAAVEADIESALQKGELASKEKSKASAVAVNAEIRRTKARLLEEVPKLQRLAVKKVKGISTEELAARNDLVLALPDRIQAIPDGTSAPKQTGGWMSSAPSASRNEIKFDSDGRFDNEYFQESEQSSQFRQEYEMRRMKQATMFHLFVLTSLQDQGLDMISEGLDTLKNMAHDMNEELDRQVPLMDEIDTKVDKAAADLKNTNVRLKDTVNQLRSSRNFCIDIVLLCIVLGIAAYLYNVLKK

SEQ ID NO: 4536 - protein, 265 aa, Vitis vinifera
MTVIDILTRVDAICKKYDKYDIDKQKDLNVSGDDAFARLYAVVEADIEAALQKADTASNEKNRASAVALNAEIRRTKARLLEEVPKLQRLAIKKVKGLSTEELAARNDLVLALPDRIQAIPDGAATAPKQTGGWAASASRTEIKFDSDGRFDSEYFQQTEESSQFRQEYEMRKMNQDQGLDVIAEGLDTLKNMAHDMNEELDRQVPLMDEIDTKVDKATADLKNTNVRLKDTVNQLRSSRNFCIDIILLCIILGIAAYLYNVLKK

SEQ ID NO: 4537 - protein, 265 aa, Populus trichocarpa
MSVIDILTRVDAICNKYDKYDVEKQKDLNVSGDDAFARLYAAVDADIEAALQKAELASKEKSKASAVAINAELRRTKARLLEEVPKLQRLAIKKVKGLSIEELAARNDLVHALPDRIQAIPDGSSAALKQTGGWGSSAPRTEIKFDSDGQFDNEYFQESETSSQFRQEYEMRKMKQDQGLSMISEGLDTLKNMAHDMNEELDRQVPLMDEIDTKVDKAAADLKNTNVRLKDTVNQLRSSRNFCIDIVLLIIILGIAAYLYNVLKK

SEQ ID NO: 4538 - protein, 265 aa, Catharanthus roseus
MSVIDILTRVDAICKKYDKYDVEKQKDSNVTGDDAFARLYSSIEEDIEAALQKAETAGKEKNRASAVAINAEIRRTKARLLEEVPKLQRLAIKKVKGLSTEELAARNDLVLALPDRIQAIPDGAAAPPKQSGGWAASASRTEIRFDSDGRFDDEYFQQTEESGKFRQEYEMRKMKQDQGLEVIAEGLDTLKNMAHDMNEELDRQVPLMDEIDSKVDKATSDLKNTNVRLKDTVNQLRSSRNFCIDIILLCIILGIAAYLYNVLKK

SEQ ID NO: 4539 - protein, 266 aa, Malus domestica
MSVIEILTRVDAICQKYDRYDVEKQKDLNVSGDDAFARLYASVESDIEAALQKAEIASKEKNRASAVALNAEIRRTKARLLEEVPKLQRLAVKKVKGLSSQDFAARNDLVHALPDRIQDIPDGTPAAPKQTGGGWAASASRTEIKFDSEGRFDNEFFQQSESSSNFRQEYEMRKMKQDQGLDVISDGLDTLKNMAQDMNEEFDRQVPLMDEIDSKVDKASADLKNTNVRLKDTVNQLRSSRNFCIDIVLLCIILGIAAYLYNVLKK

SEQ ID NO: 4540 - protein, 265 aa, Castanea mollissima
MSVIDILTRVDAICKKYDKYDVEKQKDLNVTGDDAFARLYAAVEADLESALQKAESVSKEKNKASAVALNAEVRRTKARLLEEVPKLQRLAVKKVKGLSGEELAARNDLVLALPDRIQAIPDGSAPAAKQSGGWAASASRTEIKFDSDGRFDDEYFQQTEESSGFRQEFEMRKIKQDQGLDVISEGLDTLKNMASDMNEELDRQVPLMDEIDTKVDKAAADLKNTNVRLKDTVNQLRSSRNFCIDIILLCIILGIAAYLYNVLKK

SEQ ID NO: 4541 - protein, 266 aa, Ricinus communis
MSVIDILTRVDAICQKYDRYDVEKQKDLNVSGDDAFARLYAVVEADIESALQKAEVASKEKNKASAVALNAEIRRTKAKLLEEVPKLQRLAVKKVKGLSTEELTARNDLVLALPDRIQAIPDGNAAAPKQTGGWGAPSASRTEIKFDSDGRFDNEYFQENETSSQFRQEYEMRRMKQDQGLDMISKGLDTLKDMAHDMNEELDRQVPLMDEIDTKVDKATADLKNTNVRLKDTVNQLRSSRNFCIDIVLLCIILGIAAYLYNVLKK

SEQ ID NO: 4542 - protein, 265 aa, Unknown
  Sequence found in Organisms: Citrus clementina, Citrus sinensis
MSVIDILTRVDSICKKYDKYDVEKQRETNVSGDDAFARLYGAVEADIEAALQKAESASNEKNRASVVALNAEIRRTKARLLEEVPKLQRLAIKKVKGLSTEELVARNDLVLALPDRIQAIPDGTAAAPKQSGGWGASASRTEIKFDSDGRFDDEYFQQTEESSQFRQEYEMRKMKQDQGLDMISEGLDTLKNMAHDMNEEVDRQVPLMDEIDTKVDRATADLKNTNVRLKHTVTQLRSSRNFCIDIVLLCIILGIAAYLYNVLKK

SEQ ID NO: 4543 - protein, 265 aa, Quercus alba
MSVIDILTRVDAICKKYDKYDVEKQKDLNVAGDDAFARLYAAVESDLESALQKAESASKEKNKASAVAMNAEVRRTKARLLEEVPKLQRLAVKKVKGLSGEELAARNDLVLALPDRIQAIPDGSAPAAKQSGGWAASASRTEIKFDSDGRFDDEYFQQTEESSGFRQEFEMRKIKQDQGLDMISEGLDTLKNMASDMNEELDRQVPLMDEIDTKVDKAAADLKNTNVRLKDTVNQLRSSRNFCIDIILLCIILGIAAYLYNVLKK

SEQ ID NO: 4544 - protein, 265 aa, Scabiosa columbaria
MSVIDILTRVDSICKKYDKYDIDKQKDLNVAGDDAFARLYASVESDIESAYQKAESASSEKSRASAVAINAEIRRTKARLLEEVPKLQRLAVKKVKGLSSEEYAARNDLALALPDRIQAIPDGAAAPPKQTGGWASSTSRAEIKFDSDGRFDSEYFQQTEESSNFRQEYEMRKVKQDQGLEVISEGLDTLKNMASDMNEEIDRQVPLMDEIDTKVDKATSDLKNTNVRLKDTVNQLRSSRNFCIDIILLCIILGIAAYLYNVLKK

SEQ ID NO: 4545 - protein, 108 aa, Fagus grandifolia
MSVIDILTRVDSICKKYDKYDVEKQKDLNVAGDDAFARLYAVVEADIESALQKAEAASKEKNKASAVAMNAEIRRTKARLLDEVPKLQRLASKKVKGRLRGKRLGGSQ

SEQ ID NO: 4546 - protein, 266 aa, Prunus mume
MSVIEILTRVEAICQKYDRYDVEKQKDLNVSGDDAFARLYASVDADIEALLQKAEIASKEKNKASAVALNAEIRRTKARLLEEVPKLQRLAVKKVKGLSTQDFAARNDLVHALPDRIQGIPDGTPAAPKQTGGGWAASASRTEIKFDSEGRLDNEFFQQSEESSQFRQEFEMRKIKQDQGLDMISDGLDTLKNMAQDMNEEFDRQVPLMDEIDSKVDKASADLKNTNVRLKDTVNQLRSSRNFCIDIILLCIILGIAAYLYNVLKK

SEQ ID NO: 4547 - protein, 263 aa, Nicotiana benthamiana
MSVIDILTRVDSICKKYDRYDIDKQKDSNISGDDAFARLYAAVDADIEASLQKAETASKEKNRASAVAINAEIRRTKARLLEEVPILQRLAMKKVKGLSSEEFAARNDLVLALPDRISSIPDGAAAAPKQSGGWGVSGSRAEIKFDSDGRFDNEYFQQTEESSQFRQEYEMRKMKQACDQGLEVISEGLDTLKNMASDMNEELDRQVPLMDEIDTKIDKASSDLKNTNVRLKDTVNQLRSSRNFCIDIILLIIILGIAAYLYK

SEQ ID NO: 4548 - protein, 265 aa, Olea europaea
MSVIDILTRVDAICKKYDKYDIEKQKDSNVAGDDAFARLYAAVDSDIEAALQKAETAAQEKSRASAVAINAEIRRTKARLLEEVPKLQRLAVKKVKGLSTEEIAARNDLALALPDRIQAIPDGGAAAPKQPGGWGTSAPRKEIKFDSDGRFDSEYFQQTEDSSQFRQEYEMRKMRQDQGLDVIGEGLDTLKNMAHDMNEELDRQVPLMDEIDTKVDQATSDLKNTNVRLKDTVNQLRSSRNFCIDIILLCIILGIAAYLYNVLKK

SEQ ID NO: 4549 - protein, 265 aa, Amsonia hubrichtii
MSVIDILTRVDAICKKYDKYDIEKQKDSNVSGDDAFARLYASVEEDIESALQKAETAGKEKNRASAVAINAEIRRTKARLLEEVPKLQRLAIKKVKGLSTEELAARNDLVLALPDRIQAIPDGAAAPPKQSGGWGASASRTEIKFDSDGRFDSEYFQHTEESSQFRQEYEMRKIRQDQGLEVISEGLDTLKNMAHDMNEEVDRQVPLMDEIDSKVDKATSDLKNTNVRLKDTVNQLRSSRNFCIDIILLCIILGIAAYLYNVLKK

SEQ ID NO: 4550 - protein, 260 aa, Glycyrrhiza uralensis
MSVIDILTRVDSICKKYDRYDVDKQKSSNFSAADAFAKLYALVDADIDAALQKAETASKEKSRASTVAINAEIRRIKAKLLEEVPKLQRLAVKKVKGLSSQEFAARNDLVLALPERIQAIPDGTPAAPKQTGLWGAPASRPEIKFGSDGRFDDEYFQQTEESSRFRQEYEMRKMKQDQGLDVIAEGLDTLKNMAHDMNEEMDRQVPLMDEIDTKVDKASSDLKNTNVRLKDTVTQLRSSRNFCIDIVLLIIILGIAAYLY

SEQ ID NO: 4551 - protein, 265 aa, Populus trichocarpa
MSVIDILTRVDAICNKYDKYDIEKQKDLNVSGDDAFARLYAAIDSDIEAAHQKAELASKEKSKASAVAINAELRRTKARLLEEVPKLQRLAVKKVKGLSTEELAARNDLVLALPDRIQAIPDGTAAAPKQTGGWGTSAPRAEIKFDSDGQFDNEYFQETETSSQFRQEYEMRKMKQDQGLDMISDGLDTLKNMAHDMNEEIDRQVPLMDEIDTKVDKAAADLKNTNVRLKDTVNQLRSSRNFCIDIVLLIIILGIAAYLYNVLKK

SEQ ID NO: 4552 - protein, 264 aa, Populus trichocarpa
MSVIDILTRVDAICNKYDKYDIEKQKDLNVSGDDAFARLYAAIDSDIEAALQKAELASKEKSKASAVAINAELRRTKARLLEEVPKLQRLAVKKVKGLSTEELAARNDLVLALPDRIQAIPDGTAAAPKQTGGWGTSAPRAEIKFDSDGQFDNEYFQETETSSQFRQEYEMRKMKQDQGLDMISDGLDTLKNMAHDMNEEIDRQVPLMDEIDTKVDKAAADLKNTNVRLKDTVNQLRSSRNFCIDIVLLIIILGIAAYLYNVLK

SEQ ID NO: 4553 - protein, 265 aa, Tabernaemontana elegans
MSVIDILTRVDAICKKYDKYDVDKQKDSIVSGDDAFARLYASVEEDIEAALQKAETAGKEKNRASAVAINAEIRRTKTRLLEEVPKLQRLAIKKVKGLSTEELAARNDLVLALPDRIQAIPDGAAAPPKQSGGWASSASRTEIRFDSDGRFESEYFQQTEESSQFRQEYEMRKMRQDQGLEVISEGLDTLKNMAHDMNEEFDRQVPLMDEIDTKVDKATSDLKNTNVRLKDTVNQLRSSRNFCIDIILLCIILGIAAYLYNVLKK

SEQ ID NO: 4554 - protein, 267 aa, Fragaria vesca
MSVIELLTRVEAICNKYDRYDIEKHKDSNVSGDDAFARLYASVDSDIEAALQKAELASKEKSRASAVALNAEIRRTKARLLEEVPKLQRLALKKVKGLSSEEFAARNDLAHALTDRIQDIPDGTPAAPKQSGGGWTASASRTEIKFDSSDGRFDNEFFQQTEESSQFRNEYEMRRMKQDQGLDVISEGLDTLKNMAGDMNEEFDRQVPLMDEIDSKVDKASSDLKNTNVRLKDTVNQLRSSRNFCIDIVLLIIILGIAAYLYNVLKK

SEQ ID NO: 4555 - protein, 265 aa, Nicotiana benthamiana
MSVIDILTRVDSICKKYDKYDIDKHKDSNVAGDDAFARLYSSVESDIVASLQKAETAANEKNRASVVAINAEIRRTKAKLLEEVPKLQRLAVRKVKGLSGEELAARNDLVLALPDRINAIPDGSAAPPKQSGGWRASGSRTEIKFDSDGQFDNEYFQQTEESSQFRQEYEMRKMRQDQGLEVIAEGLDTLKNMASDMNEELDRQVPLMDEIDTKVDKATSDLKNTNVRLKDTVNQLRSSRNFCIDIILLIIILGIAAYLYNVLKK

SEQ ID NO: 4556 - protein, 266 aa, Vaccinium corymbosum
MSVIDILTRVDAICQKYDKYDIEKQKDLNNVSGDDAFARLYAAVESDIDAALQKAEAASKEKSRASVVAINAEIRRTKARLLEEVPKLQRLAVKKVKGLSTEEYVARNDLVLALPDRIEAIPDGTAAAPKQSGGWLAPASRAEIKFDSTGRFDDEYFQQTEESSQFRQEYEMRKMKQDQGLDVIAEGLDTLKNMAHDMNEEFDRQVPLMDEIDAKVDKATSDLKNTNVRLKHTVNQLRSSRNFCIDIILLCIILGIAAYLYNVLKK

SEQ ID NO: 4557 - protein, 266 aa, Eucalyptus grandis
MSVIDILTRVDSICKKYDKYDVEKHKDASNVAGEDAFARLYAAVEADVEAAEQKAEAAATEKSRASAVALNAEIRRTKARLLEEVPKLQRLAMKKVKGLSSEEFAARNDLALALPDRIENIPDGTAPAPKKAGGWTTSASRAEIKFDSDGRMDSDYFQQTEGSSQFRQEYEMRKLKQDQGLDVIAEGLDTLKNMAHDMNEELDRQVPLMDEIDTKVDKAASDLKNTNVRLKDTVTQLRSSRNFCIDIVLLCIILGIAAYLYNVLKK

SEQ ID NO: 4558 - protein, 260 aa, Lotus japonicus
MSVIDILTRVDSIVNKYDKYDIDKQKDSNVSGDDPFAKLYAAVDADIDAALQKAETASNGKNRASTVAINAEIRRTKARLLDEVPKLQRLAVKKVKGLSSQEFAARNDLVLALPERIQAIPDGTPAAPKQAGGWAASGSRPEIKFDSNGRFDDEYFQQTEESSQFRQEYEMRKMKQASLDVIAEGLDTLKNMAHDMNEEFDRQVPLMDEIDTKVDKASSDLKNTNVRLKHTVTQLRSSRNFCIDIVLLIIILGIAAYLYK

SEQ ID NO: 4559 - protein, 272 aa, Prunus persica
MSVIEILTRVEAICQKYDRYDVEKQKDLNVSGDDAFARLYASVDADIEALRQKAEIASKEKNKASAVALNAEIRRTKARLLEEVPKLQRLAVKKVKGLSTQDFAARNDLVHALPDRIQDIPDGTPAAPKQTGGGWAASASRTEIKFDSEGRLDNEFFQQSEESSQFRQEFEMRKIKQASYRYCDQGLDMISDGLDTLKNMAQDMNEEFDRQVPLMDEIDSKVDKASADLKNTNVRLKDTVNQLRSSRNFCIDIILLCVILGIAAYLYNVLKN

SEQ ID NO: 4560 - protein, 265 aa, Nicotiana tabacum
  misc_feature (44)..(44): Xaa can be any naturally occurring amino acid
MSVIDILTRVDSICKKYDKYDIDKHKDSNVAGDDAFARLYSSVXSDIEASLQKAETAANEKNRASVVAINAEIRRTKAKLLEEVPKLQRLAVRKVKGLSGEELAARNDLVLALPDRINAIPDGSAAPPKQSGGWRASGSRTEIKFDSDGQFDNEYFQQTEESSQFRQEYEMRKMRQDQGLEVIAEGLDTLKNMASDMNEELDRQVPLMDEIDTKVDKATSDLKNTNVRLKDTVNQLRSSRNFCIDIILLIIILGIAAYLYNVLKK

SEQ ID NO: 4561 - protein, 262 aa, Tripterygium wilfordii
IDILTRVDAICKKYDKYDIEKQKDSNVSGEDAFARLYASVEADIEAALQKAELASNEKNRASAVALNAEIRRIKARLLEEVPKLQRLALKKVKGLSSEEFAARNDLVLALPDRIQAIPDGTTGAPKQGGGWTSSASRAEVKFDSDGQFDDEYFQHSESSSQFRQEYEMRKIKQDQGLDMISEGLDTLKNMAQDMDEELDRQVPLMDEIDTKVDKATSDLKNTNVRLKDTVNQLRSSRNFCIDIVLLCIILGIAAYLYNVLKK

SEQ ID NO: 4562 - protein, 265 aa, Momordica charantia
MSVIDLLTRVDAICQKYDKYDVEKQRDLNVSGDDAFARLYATVEADIEAALQKAEDASKEKNRASVVALNAEIRRTKARLLEEVPKLQRLAVKRVKGLSTEDLTTRNDLVLALPDRIQAIPDGTTTATKKTGGWTSSASRTDIKFDSDGRFDDEYFQHTEESSQFRQEYEMRKMKQDQGLDMISEGLDTLKNMAHDMNEEIDRQVPLMDEIDTKVDKAASDLKNTNVRLKHTVNQLRSSRNFCIDIVLLCIILGIAAYLYNVLKK

SEQ ID NO: 4563 - protein, 265 aa, Tropaeolum majus
MSVIDILTRVDAICQKYDKYDIEKQREANVSGADAFARLYSSVEADIEAALEKAEVASKEKNKASAVAMNAEIRRTKARLLEEVPKLQRLAVKKVKGISTEELAARNDLVLALPDRIGAIPDGTLNAPKQTGGWNTSAPRTEIKFDSGGQFNDEYFQQSEGSSQFRQEYEMRKINQDQGLEMISEGLDTLKNMAHDMNEEFDRQVPLMDEIDSKVDKASSDLKNTNVRLKHTVNQLRSSRNFCIDIVLLCIILGIAAYLYNVLKK

SEQ ID NO: 4564 - protein, 235 aa, Cleome spinosa
MSVIDILTRVDAICKKYDKYDVEKQREANVSGDDAFARLYASVENDIETALEKAELASKEKSRASAVAMNAEIRRTQARLLEEVPKLQRLAVKRVKGLSTEELAARNDLVLALPDRIEAIPDGTAGGPKKTSAWSASASRAEIKFDSDGHFDDDYFQESKESSQYRQEYEMRKMKQDQGLDMISEGLDTLKNMAHDMNEELDRQVPLMDEIDTKVDKQQQTLRTPMSGLKTLSTS

SEQ ID NO: 4565 - protein, 267 aa, Gossypium hirsutum
MSVIDILTRVDVICKRYDKYDVEKQRDQNVSGDDAFARAYAAVEADIESALEKVELASKEKSKASAVAVNAEIRRTKARLLEEVPKLQRLAVKKVKGISTEEMAARNDLVLALPDRIQAIPDGTADTKQTGGWMSSAPSASRTAIKFDSDERFDNEYFQESEQSSQFGQEYEMRKMKQDQGLDMISEGLDTLKNMAHDMNEELDRQVPLMDEIDTKVDKAAADLKNTNVRLKDTVTQLRSSRNFCIDIVLLCIVLGIAAYLYNVLKK

SEQ ID NO: 4566 - protein, 265 aa, Olea europaea
MSVIDLLTRVDAICKKYDKYDIEKQKDSNVSGDDAFARLYAAVESDIEEALQKAEKASGESNRASAVAINAEIRRTKARLIEEVPKLQRLAVKKVKGLSAEELAARNDLVLALPDRIQAIPDGAAAAPTKSGGWGSSAPRKEIKFDSDGRFDSEYFQQTEGSSQFRQEYEMRKMKQDQGLDTIAEGLDTLKNMAHDMNEEFDRQVPLMDEIDTKVDRATADLKNTNVRLKDTVNQLRSSRNFCIDIILLCIILGIAAYLYNVLKK

SEQ ID NO: 4567 - protein, 265 aa, Valeriana officinalis
MSVIDILTRVDSICKKYDKYDIDKQKDLNVAGDDAFARLYAAVESDIESAYQKAETASTEKNRAAAVAINAEIRRTKARLLEEVPKLQRLAMKKVKGLSSEEYAARNDLAIALPDRIQDIPDGGAPAPKQTGGWASSASRAEIKFDSDGRFDDEYFQQSEESSNFRQEYEMRKVKQDQGLEVISEGLSTLKNMASDMNEELDRQVPLMDEIDSKVDKATSDLKNTNVRLKDTVHQLRSSRNFCIDIILLCIILGIAAYLYNVLKK

SEQ ID NO: 4568 - protein, 265 aa, Citrullus lanatus
MSVIDLLTRVDAICQKYDKYDVEKQRDLNVSGDDAFARLYATVEADIEAALQKAEDASKEKNRASVVALNAEIRRTKARLLEEVPKLQRLAVKRVKGLSTEDLTTRNDLVLALPERIQAIPDGTATSTKNNGGWTSSASRAEIKFDSDGRFDDEYFQHTEESSQFRQEYEMRKMKQDQGLDMISEGLDTLKNMAHDMNEEIDRQVPLMDEIDTKVDKAASDLKNTNVRLKDTVNQLRSSRNFCIDIILLCIILGIAAYLYNVLKK

SEQ ID NO: 4569 - protein, 267 aa, Gossypium raimondii
MSVIDILTRVDVICKRYDKYDVEKQRDQNVSGGDAFARAYAAVEADIESALEKVELASKEKSKASAVAVNAEIRRTKARLLEEVPTLQRLAVKKVKGISTEEMAARNDLVLALPDRIQAIPDGTAATKQTGGWMSSAPSASRTAIKFDSDERFDNEYFQESEQSSQFRQEYEMRKMKQDQGLDMISEGLDTLKNMAHDMNEELDRQVPLMDEIDTKVDKAAADLKNTNVRLKDTVTQLRSSRNFCIDIVLLCIVLGIAAYLYNVLKK

SEQ ID NO: 4570 - protein, 266 aa, Euonymus alatus
MTVIDILTRVDAICKKYDKYDVEKLKESNVSGEDAFARLYAAVEADIEAALQKAEKASNEKNRASLVALNAEIRRIKARLLEEVPKLQRLALKKVKGLSSEEFAARNDLVLALPDRIQAIPDGTTGAPKQGGGWTSSASRAEIKFDSVDGQFDDEYFQRSESSDQFRQEYEMRKIKQDQGLDMISEGLDTLKNMAQDMDEEFDRQVPLMDEIDTKVDKATSDLKNTNVRLKHTVNQLRSSRNFCIDIVLLCIILGIAAYLYNVLKK

SEQ ID NO: 4571 - protein, 266 aa, Euonymus alatus
MTVIDILTRVDAICKKYDKYDVEKLKESNVSGEDAFARLYAAVEADIEAALQKAEKASNEKNRASLVALNAEIRRIKARLLEEVPKLQRLALKKVKGLSSEEFAARNDLVLALPDRIQAIPDGTTGAPKQGGGWTSSASRAEIKFDSVDGQFDDEYFQHSESSDQFRQEYEMRKIKQDQGLDMISEGLDTLKNMAQDMDEEFDRQVPLMDEIDTKVDKATSDLKNTNVRLKHTVNQLRSSRNFCIDIVLLCIILGIAAYLYNVLKK

SEQ ID NO: 4572 - protein, 265 aa, Triphysaria pusilla
MSVIDLLTRVDAICKKYDKYDIAAKDPNISGDDAFARLYASVESDIESLLQKAEAASSEKSRASAVAINAEIRRTKARLAEEIPKLQRLAVKKVKGLSTEEFAVRNDLVLALPARIQAIPDGSAAAPKSSGGWGGTSAPRNEIKFDSDGRFDDEYFQKTEESSQFRQEYEMRKMKQDQGLDVIAEGLDTLKNMAHDMNEELDRQVPLMDEIDTKVDKATSDLKNTNVRLKDTVNQLRSSRNFCIDIILLCVILGIAAYLYNVLRK

SEQ ID NO: 4573 - protein, 261 aa, Manihot esculenta
MSVIDILTRVDVICKKYDKYDLEKHKDLNVSGDDAFARLYAVVESDIEAALQKADLASKEKNKASAVALNAEIRRTKAKLLEEIPKLQRLAIKKVKGLSTEELAARNDLVLALPDRIQAIPDGTAAASKQTGGWGASASRTEIKFDSDGHFDSEYFQENETSSQFRQEYEMRRMKQDQGLDMISEGLDTLKNMAHDMNEELDKQVPLMDEIDTKVDKATADLKNTNVRLKDTVNQLRSSRNFCIDIILLCIILGIAAYLYK

SEQ ID NO: 4574 - protein, 264 aa, Actinidia deliciosa
MSVIDILTRVDAICQRYDKYDIDKQKDLNVSGDDAFARLYAAVEADIDVALQKSDAVSNEKNRASAVAINAEIRRTKARLLEEVPKLQRLAVKKVKGLSTEELAARNDLVLALPDRIEAIPDGTSSATKQTGRWVASASRTEIKFDSDGRFDNEYFQQTEESSQFRQEYEMRKMKQDQGLEVIAEGLDTLKNMAHDMNEEMDRQVPLMDEIDAKVDKAASDLKNTNVRLKDTVNQLRSSRNFCIDIILLCIILGIAAYLYNVLK

SEQ ID NO: 4575 - protein, 267 aa, Solanum phureja
MSVIDILTRVDSICKKYDKYDIDKQKDSNVAGDDAFARLYSSVESDIETALQKAETASNEKNRASVVAINAEIRRTKARLLEEVPKLQRLAVRKVKGLSGEELAARNDLVLALPDRINAIPDGSAAPPKQSGGWRASGSRTEIKFDSDGQFDNEYFQQTEESSQFKQEYEMRKMRQACDQGLDVIAEGLDTLKNMASDMNEELDRQVPLMDEIDAKVDRATADLKNTNVRLKHTVNQLRSSRNFCIDIILLCIILGIAAYLYNVLKK

SEQ ID NO: 4576 - protein, 267 aa, Gossypium hirsutum
MSVIDILTRVDVICKRYDKYDVEKQRDQNVSGGDAFARAYAAVEADIESALEKVELASKEKSKASAVAVNAEIRRTKARLLEEVPTLQRLAVKKVKGISTEEMATRNDLVLALPDRIQAIPDGTAATKQTGGWMSSASSASRTAIKFDSDERFDNEYFQESEQSSQFRQEYEMRKMKQDQGLDMISEGLDTLKNMAHDMNEELDRQVPLMDEIDTKVDKAAADLKNTNVRLKDTVTQLRSSRNFCIDIVLLCIVLGIAAYLYNVLKK

SEQ ID NO: 4577 - protein, 266 aa, Gossypium raimondii
MTVIDILTRVDVICKKYDKYDVEKQRDQNISGDDAFARQYAAIEADIESALQKAELVSKEKSKASAVAVNAEIRRTKARLLEEVPKLQRLAVKKVKGISTEEMTARSDLVLALPDRIQAIPDGTAAPKTGGWMSSAPSASRTEIKFDSDGRFDNEYFQESEQSSQFRQEYEMRRIKQDQGLDMISEGLDTLKNMAHDMNEELDRQVPLMDEIETKVDKAAGDLKNTNVRLKHTVTQLRSSRNFCIDIVLLCIVLGIAAYLYNVLKK

SEQ ID NO: 4578 - protein, 260 aa, Medicago truncatula
MSVIEILTRVDTICKKYDRYDVVKHNDANVSADDAFAKLYAIFDANIEAALQKAETASKEKNRASTVAINAEIRRTKARLLEEIPKLQRLAVKKVKGLSLQEFSTRNDLVLSLPERIQAIPDGTPAAPKQTGGWGASATRPEIKFDSDGRLDDGYFEPTKESSQFRQEYEMRKMKQASLDVIAEGLDTLKNMAHDMNEEFDRQVPLMDEIDTKVDKASSDLKNTNVRLKDTVTQLRSSRNFCIDIVLLIIILGIAAYLYK

SEQ ID NO: 4579 - protein, 265 aa, Solanum lycopersicum
MSVIDILTRVDSICKKYDKYDIDKQKDSNVAGDDAFARLYSSVESDIETALQKAETASIEKNRASIVAINAEIRRTKARLLEEVPKLQRLAVRKVKGLSGEELAARNDLVLALPDRINAIPDGSAAPPKQSGGWRASGSRTEIKFDSDGQFDNEYFQQTEESSQFRQEYEMRKMRQDQGLDVIAEGLDTLKNMASDMNEELDRQVPLMDEIDAKVDRATADLKNTNVRLKHTVNQLRSSRNFCIDIILLCIILGIAAYLYNVLKK

SEQ ID NO: 4580 - protein, 265 aa, Vinca minor
MSVIDILTRVDSICKKYDRYDIDKQKDSNISGDDAFARLYSSIEEDIEAALQKAETAGNEKSRASAVAINAEIRRTKARLLEELPKLQRLAIKKVKGLSTEELVARNDLVLALPDRIQAIPDGAAAPPKQTGGWGASASRQEIRFDSDGRFDGEYFQQTEESSNFKQEYEMRKIRQDQGLEVIGEGLDTLKNMAHDMNEELDRQVPLMDEIDTKVDKATSDLKNTNVRLKHTVNQLRSSRNFCIDIILLCIILGIAAYLYNVLKK

SEQ ID NO: 4581 - protein, 265 aa, Ambrosia trifida
MSVIELLTRVDAICKKYDKYDVEKQRDLNISGDDAFARLYAAVESDIESALQKAETAKNEKNRASVVAINAEIRRTKAKLLEEIPKLQRLAMKKVKGLAPEEFAARNDLVQALPDRIQAIPDGGAAAPKQTGGWAASASRTNNIKFDSDGRFDDEYFQQSEESSQFRNEYEMRKMKQDQGLDVISEGLDTLKNMAQDMNEEVDRQVPLMDEIDDKVDKATSDLRNTNVRLKHTVNQLRSSRNFCIDIILLCIILGIAAYLYNVLK

SEQ ID NO: 4582 - protein, 266 aa, Gossypium hirsutum
MTVIDILTRVDVICKKYDKYDVEKQRDQNISGDDAFARQYAAIEADIESALQKAELVSKEKSKASAVAVNAEIRRTKARLLEEVPKLQRLAVKKVKGISTEEMTARSDLVLALPDRIQAIPDGTAAPKTGGGMSSAPSASRTEIKFDSDGRFDNEYFQESEQSSQFRQEYEMRRIKQDQGLDMISEGLDTLKNMAHDMNEELDRQVPLMDEIETKVDKAAGDLKNTNVRLKHTVTQLRSSRNFCIDIVLLCIVLGIAAYLYNVLKK

SEQ ID NO: 4583 - protein, 265 aa, Guizotia abyssinica
MSVIEILTRVDAICKKYDKYDIEKQRDLNVAGDDAFARLYAAVESDIETALQKAETAKNEKNRASVVAINAEIRRTKAKLLEEVPKLQRLAMKKVKGLAPEEFAARNDLVQALPDRIQAIPDGGAAAPKQTGGWAASASRTNNIKFDSDGRFDDEYFQQSEESSQFRNEYEMRKIKQDQGLDVIAEGLDTLKNMAQDMNEEIDRQVPLMDEIDDKVDKATSDLRNTNVRLKHTVHQLRSSRNFCIDIILLCIILGIAAYLYNVLK

SEQ ID NO: 4584 - protein, 265 aa, Helianthus annuus
MSVIEILTRVDAICKKYDKYDVEKQRDLNISGDDAFARLYATVESDIETALQKAETAKNEKNRASVVAINAEIRRTKAKLLEEVPKLQRLAMKKVKGLAPEEFAARNDLVQALPDRIQAIPDGGAAAPKQTGGWAASASRTNNIKFDSDGRFDDEYFQQSEESSQFRNEYEMRKMKQDQGLDMISEGLDTLKNMAQDMNEEVDRQVPLMDEIDDKVDKATSDLRNTNVRLKHTVHQLRSSRNFCIDIILLCIILGIAAYLYNVLK

SEQ ID NO: 4585 - protein, 265 aa, Coffea canephora
MSVIEILTRVDAICKKYDKYDIDKQKDANIAGDDAFARLYSAIQSDIEAALQKAETAANEKNRASAVAINAEIRRTKAKLLEEVPKLQRLAVKKVKGLSGEELAARNDLVLALPDRIQAIPDGAAAAPKQSGGWGASASRTEIKFDSDGRFDSDYFQQTDESNNFRQEYEMRKVRQDQGLEVISEGLDTLKNMAHDMNEELDRQVPLMDEIDTKVDKATSDLKNTNVRLKDTVNQLRSSRNFCIDIILLCIILGIAAYLYNVLKK

SEQ ID NO: 4586 - protein, 265 aa, Cucurbita pepo
MSVIDLLTRVDAICQKYDKYDVEKQRDLNVSGDDAFARLYATVEADIEAALQKAEDASREKNRASVVALNAEIRRTKARLLEEIPKLQRLALKRVKGLSTEDLTTRNDLVLALPDRIQAIPDGTATSTKKNGGWTSSASRTEIKFDSDGRFDDEYFQHTEESSQFRQEYEMRKMKQDQGLDMISEGLDTLKNMAHDMNEEIDRQVPLMDEIDTKVDKAASDLKNTNVRLKHTVNQLRSSRNFCIDIILLCIILGIAAYLYNVLKK

SEQ ID NO: 4587 - protein, 261 aa, Cucumis sativus
MSVIDLLTRVDAICQKYDKYDIEKQRDLNVSGDDAFARLYATVEADIEAALQKAEDASKEKNRASVVALNAEIRRTKARLLEEVPKLQRLAVKRVKGLSTEDLTTRNDLVLALPDRIQAIPDGTVTTTKNNGGWTSSASRTEIKFDSDGRFDDEYFQHTEQSSQFRQEYEMRKMKQDQGLDMISEGLDTLKNMAHDMNEEIDRQVPLMDEIDTKVDKAASDLKNTNVRLKDTVNQLRSSRNFCIDIILLCIILGIAAYLYK

SEQ ID NO: 4588 - protein, 266 aa, Helianthus annuus
MSVIEILTRVDAICKKYDKYDVEKQRDLNISGEDAFARLYATVESDIETALQKAETAKNEKNRASVVAINAEIRRTKAKLLEEVPKLQRLAMKKVKGLSPEEFAARNDLVQALPDRIQAIPDGGAAAPKQTGGWAASASRTNNNIKFDSDGRFDDEYFQQSEESSQFRNEYEMRKMKQDQGLDMISEGLDTLKNMAQDMNEEVDRQVPLMDEIDDKVDKATSDLRNTNVRLKHTVHQLRSSRNFCIDIILLCIILGIAAYLYNVLK

SEQ ID NO: 4589 - protein, 265 aa, Cynara scolymus
MSVIEILTRVDAICKKYDKYDVEKQRDLNVSGDDAFARLYAAVESDIESALQKAETASNEKNRASVVAINAEIRRTKAKLLEEIPKLQRLAMKKVKGLAPEEFAARNDLVLALPDRIQAIPDGGAAAPKQSGGWAASASRTQIKFDSSDGRFDDEYFQQTEESSQFRNEYEMRKMKQDQGLEMISEGLDTLKNMAQDMNEEVDRQVPLMDEIDDKVDKATSDLRNTNVRLKHTVNQLRSSRNFCIDIILLCVILGIAAYLYNVLK

SEQ ID NO: 4590 - protein, 234 aa, Solanum lycopersicum
MAPAPSETITTDVSSENNNVTITGKIYTRVRLATKSDLSHIYKLFYQIHEYHNFTHLYKATESSLANLLFKENPLPLFYGPSVLLLEVSPTPFDEPKNTTDEGFKPILTTFDLKFPVVEGEVEEFRSKYDDKSDAYIAGYAFFYANYSCFNDKPGFYFESLYFRESYRKLGMGKLLFGTVASIAANNGFVSVEGIIAVWNKKSYDFYINMGVEVFDEFRYGKLHGENLQKYAHN

SEQ ID NO: 4591 - protein, 240 aa, Solanum lycopersicum
MAPALQQSITSDASSDVTITGKIYTRVRLATKSDLSHIYKLFYQIHVYHNYTHLYKATESSLANLLFKENPLPLFYGPSVLLLEVSPTPFDEPKNTTDEGFKPVLTTFDLKFPVVEGEVEEFRSKYDDKSDAYIAGYAFFYANYSCFNDKPGFYFESLYFRESYRKLGMGKLLFGTVSSIAADNGFVSVDGIVAVWNKKSYDFYINMGVEIFDEFRYGKLHGENLQKYAHNKGEIEEETC

SEQ ID NO: 4592 - protein, 208 aa, Solanum phureja
MAPALQQSEAIITTNSSSENNNVTITGKIYTRVRLATKSDLSHIYQLFYQIHEYHNYTHLYKAIGSPLANLLFKENPLPLFYGPSVLLLEVSPTPFNEPKNTTDKGFKPVLTTFDLKFPVVEGQVEEFRSKYDDKSDAYIAGYAFFYANYSCFYDKPGFYFESLYFREIYRKLGMGSLLFGTVASIYCCKQWVRIGRGNSSSLEQEII

SEQ ID NO: 4593 - protein, 72 aa, Solanum lycopersicum
MGKLLFGTVSSIAADNGFVSVDGIVAVWNKKSYDFYINMGVEIFDEFRYGKLHGENLQKYAHNKDKNDEESC

SEQ ID NO: 4594 - protein, 134 aa, Solanum phureja
MASSLSETITTDDASSENNNVTITGKIYTRLRLATKSDLSHIYQLFYQIHAYHKNTHLYKATESSLANLLFKENPLPLFYGPSVLLLEVSPTPFNEPRTKGSSPSLQRSTLNSLWWKDKLRSSNQNMMIRVMFT

SEQ ID NO: 4595 - protein, 248 aa, Solanum phureja
MAPALQQPTPSETITIDASSESNNVTITGKIYTRVRLATKSDLSHIYQLFYQIHEYHNYTHLYKSTESSLANLLFKENPLPLFYGPSVLLLEVSPTPFNEPKNTTNEGFKPVLTTFDLKFPVVEGQVEEFRSKYDDKSDAYIAGYAFFYANYSCFYDKPGFYFESLYFRESYRKLGMGKLLFGTVASIAANNGFVSVEGIIAVWNKKSYDFYINMGVEIFDEFRYGKLHGENLQKYADNKGEIKEANC

SEQ ID NO: 4596 - protein, 239 aa, Solanum lycopersicum
MASSLSETITTDASSENNNVTITGKIYTRLRLATKSDLSHIYQLFYQIHAYHNNTHLYKATESSLANLLFKENPLPLFYGPSVLLLEVSPTPFNEPTNEGFKPVLTTFDLKFPVVEGQVEEFRSKYDDKSDVYIAGYAFFYVNYSCFSDKPGFYFESLYFRESYRKLGMGSLLFGTVASIAANNGFVSVEGIVAVWNKKSYDFYVNMGVEIFDEFRYGKLHGENLQKYANDKEKNDGGN

SEQ ID NO: 4597 - protein, 72 aa, Solanum tuberosum
MAPATQQLTPSPSEIITTDASSGKQQRYHHWERYTHEFVLLRNLIYLIYTNCFTKSMNTIITLTYTKLPSPP

SEQ ID NO: 4598 - protein, 124 aa, Solanum phureja
MAPATQQPTPSPSEIITTDASSENNNVTITGKIYTRVRLATKSDLSHIYQLFYQIHEYHNYTHLYKATESSLEGLLFKENPLPLFYGPSVLLLEVSPTPFNEPKNTTNEGFTPSLQRSTLNSLW

SEQ ID NO: 4599 - protein, 194 aa, Solanum phureja
CGQLILDNNVAITGKIYTRVRLATKSDLSHIYQLFYQIHEYHNYTHLYKATESSLEGLLFKENPLPLFYGPSVLLLEVSPTPFNEPKNTTNEGFKPVLTTFDLKFPVVEGQVEEFRSKYDHKNDAYIAGYAFFYANYSCFYDKPGFYFESLYFRESYRKLGMGKLLFGTVASIAANNGFVSVEAQFGIRSHIFT

SEQ ID NO: 4600 - protein, 248 aa, Solanum tuberosum
MAPAPQLSTPSETITTDASSENNNVTITEKIYTRVRLATKSDLSHIYQLFYQIHVYHNYTHLYKATESSLEGLLFKENPLPLFYGPSVLLLEVSPTPFNEPKNTTNEGFKPVLTTFDLKFPVVEGQVEEFRSKYDDKSDAYIAGYAFFYANYSCFYDKPGFYFESLYFRESYRKLGMGKLLFGTVASIAANNGFVSVEGIIAVWNKKSYDFYINMGVEIFDEFRYGKLHGENLQKYADNKDKNDRGSC

SEQ ID NO: 4601 - protein, 202 aa, Solanum tuberosum
MASSATITTDTSSENNNITITGEIYTRLRLATKSDLYHIYQLFYQIHAYHKNTHLYKATESSLENLLFKENPLPLFYGPSVLLLEVSPTPFNEPKNTTDEGFKPVLTTFDLKFPVVEGQVEEFRSKYDDKSDAYIAGYAFFYANYSCFYDKPGFYFESLYFRESYRKLGMGSLLFGTVASIAANNGFVSVEGIVAVWNKEVI

SEQ ID NO: 4602 - protein, 247 aa, Solanum phureja
MAPAPQQPTPSETIITDASSENNNVTITGKINTRVRLATKSDLSHIYQLFYQIHEYHNYTHLYKATESSLANLLFKENPLPLFYGPSVLLLEVSPTPFNEPKNTTNEGFKPVLTTFDLKFPVIEGEVEEFRSKYDDKSDAYIAGYAFFYANYSCFNDKPGFYFESLYFRESYRKLGMGKLLFGTVSSIAADNGFVSVDGIVAVWNKKSYDFYINMGVEIFDEFRYGKLHGENLQKYADKGKIEEETC

SEQ ID NO: 4603 - protein, 251 aa, Solanum phureja
MAPAPQLPTPSETITTDASSENNNVTITGKIYTRVRLATKSDLSHIYQLFYQIHEYHNYTHLYKATESSLANLLFKENPLPLFYGPSVLLLEVSPTPFNEPKNTTNEGLKPVLKTFDLKFPVVEGQVEEFRSKYDDGNDKSDVYIAGYAFFYANYSCFYDKPGFYFESLYFRESYRKLGMGSLLFGTVASIAANNGFVSVEGIVAVWNKKSYDFYINMGVEIFDEFRYGKLHGENLQKYADNKDENGEGSC

SEQ ID NO: 4604 - protein, 250 aa, Solanum melongena
MAPSSQQPTLSETITTDVDASSENNNVTITGKIYTRVRLATKPDLSHIYKLFYQIHEYHNFTHLYKATESSLGNLLFKENPLPLFYGPSVLLLEVSPTPFDEPKNNTDEGFKPVLTTFDLKFPVVEGQVEEFRSKYDDKSDAYIAGYAFFYANYSCFYDKPGFYFESLYFRESYRKLGMGKLLFGTVASIAANNGFVSVEGIVAVWNKKSYDFYIDRGVEIFDEFRYGKLHGENLQKYADSKDKNGGGSC

SEQ ID NO: 4605 - protein, 247 aa, Solanum tuberosum
MAPAPQQPTPSETIITDASSENNNVTITGKIYTRVRLATKSDLSHIYQLFYQIHVYHNFTHLYKATESSLEGLLFKENPLPLFYGPSVLLLEVSPTPFNETKNTTNEGFKPVLTTFDLKFPVIEGEVEEFRSKYDDKSDAYIAGYAFFYANYSCFNDKPGFYFESLYFRESYRKLGMGKLLFGTVSSIAADNGFVSVDGIVAVWNKKSYDFYINMGVEIFDEFRYGKLHGENLQKYADKGKIEEETC

SEQ ID NO: 4606 - protein, 237 aa, Solanum lycopersicum
MTPSLQQPIPSESITSDASSDVTITGKIYTRVRLATKSNLSHIYKLFYQIHEYHNYIHLYRASESSLANLLFKENPLPLFYGPSVLLLEVSQTPFKEPTNEGFKPVLTTFDLKFPVVEGEVEEFRSKYDDKSDAYIAGYAFFYANYSCFNDKPGLYLESLYLRESYRNLGMGKLLFGTVASIAANNGFVSVEEIVAVWNKKAYDLYINMGLEIFDEFRYGKLHGENIKMYADKNVGN

SEQ ID NO: 4607 - protein, 243 aa, Nicotiana benthamiana
MASTISETITNSTPENNVMITEKIYTRVRLATKADLYHIYQLFYQIHAYHNNTHLYKATESSLENLLFKENSLPLYYGPSVLLLEVSPTPFTESKHTTNQGFKPVLKTFDLKFPVVEGEADEFRSKYDDGNDKRDVFIAGYAFFYANYSCFYDKPGFYFESLYFRESYRKLGMGRLLFGTVASIAANNGFVSVEGIVAVWNKKSYDFYIEMGVEIFDEFRYGKLHGDALQKYADKEKNGEGSC

SEQ ID NO: 4608 - protein, 246 aa, Solanum lycopersicum
MAPTSQQPTPSPSLSDSLTTDASSDVTITGKIYTRVRLATKSDLSHIYKLFYQIHEYHNFTHLYKATESSLEGLLFKENPLPLFYGPSVLLLEVSPTPFNEPTNQAFKPVLTTFDLKFPVVEGQVEEFRSKHDDKSDAYIAGYAFFYANYSCFNDKPGFYFESLYFRESYRKLGMGKLLFGTVSSIAANNGFVSVDGIIAVWNKKSYDFYINMGVEIFDEFRYGKLHGENLQKYAHNKGKTEEETC

SEQ ID NO: 4609 - protein, 246 aa, Capsicum annuum
MASAISETITTNGSSENNNLTITGKIHTRVRLATKSDLHHIYQLFYQIHAYHNFTHLYKTTESSLGDLLFKENPLPLFYGPSVLLLEVSPTPFTQPKNNKDELGFKPVLTTFDLKFPVVEGQVEEFQSIYDDGNDKRDVFIAGYAFFYANYSCFYDKPGFYFESLYFRESYRKLGMGRLLFGTVASIAANNGFVSVEGIVAVWNKKSYDFYIDMGVEIFDEFRYGKLHGENLQKYADKQKNEGGNC

SEQ ID NO: 4610 - protein, 436 aa, Nicotiana benthamiana
MKKLKPLLHLLLPLCVHWIAEEMTVSVLVDVTTSALCPGNSTCSEAIYINGVQQTVVGIFKMLVLPILGQLSDEYGRKPLLLLTISTTIIPFGLLTINKSKGFVYAYYVLRTISYIISQGSIFCISVAYAADVVDESSRAAVFSWITGLFSASHVMGNVLARFLPVGYIFQVSIVLLIFVPVYMILFLEETVSPQTEVDQSSTVKSKALKVVQERYNSMRYAANIVTSSPTLKCISLVSFFYELGMSGISSVLLYYLKSAFGFNKNQFSEILMMVGVGSIVSQIVVLPLINPLFGEKVILCMALLSSIAYAMLYGLAWAPWVPYLSASFGVIYILVKPSTYAVISKAALSADQGKAQGFVAGVQSVASLLSPIVMSPLTSWFLSRDAPFNCKGFSILCASLCMVVSLYYACVLKVEAPLKKTFDENAENIEAPLLA

SEQ ID NO: 4611 - protein, 66 aa, Solanum phureja
KPSEHQTPKFSNMQRSTKLSDEQEFSIMVNALTNVITVPQFHYLLRALSLPCFVYRQNQSVVNSAK

SEQ ID NO: 4612 - protein, 231 aa, Solanum phureja
HNQEQTASMNKQPKFSDEQEFSIIVAALTNVITGTTHTSVSATISLPCTSMSYSIEPPLFHLPEETEACQFCKINGCLGCNYFATSSAGNNNKALKIVAKKKKKNYRGVRQRPWGKWAAEIRDPRRAARVWLGTFTTAEDVARAYDRAAIEFRGPRAKLNFSFSDYTSIQQHNNTPLQVQQQQSPPSQLQQGMNTEEEEFWDQLMNSDNEIQHYFNRESSDSANGYIAHSF

SEQ ID NO: 4613 - protein, 285 aa, Pseudoroegneria spicata
  misc_feature (26)..(26): Xaa can be any naturally occurring amino acid
MMEARMPPGFRFHPRDEELVLDYLLXKLTGRRAYGGVDIVDVDLNKCEPWDLPEAACVGGREWYFFSLRDRKYATGQRTNRATRSGYWKATGKDRAILAHGAGEALVGMRKTLVFYQGRAPKGTRTEWVMHEFRLEEERQHQQKGGGAAAAEARCQLKEDWVLCRVFYKSRTTSPRPPSEEACTFFSELDLPTVPPPLAPLIDAYIAFDSGTAMNTIEQVSCFSGLPALPLRGSVSFGDLLGWDNPEKKAIRTALSNMSSNSNSKLELTPNWSQENGLSQMWTPL

SEQ ID NO: 4614 - protein, 185 aa, Secale cereale
MSSIGMMEARMPPGFPFPPTGRGAGPRLPPPQAHRPARIRWRRHRGRRPQQVRAMGPSRGGVRGRQGVVLLQPARPQVRHRPAHQPRHAVRLLEGHRQGPRHPRRRGVGGDAQDARLLPGEGAQGDEDGVGHARVPPGGGTTPPAQGPRRHRHRHRRGGEVPAQGRLGAMQGVLQEQNNQPKATI

SEQ ID NO: 4615 - protein, 291 aa, Leymus cinereus x Leymus triticoides
  misc_feature (256)..(256): Xaa can be any naturally occurring amino acid
  misc_feature (267)..(267): Xaa can be any naturally occurring amino acid
  misc_feature (284)..(284): Xaa can be any naturally occurring amino acid
MMETRMPPGFRFHPRDEELVLDYLLHKLTGRRAYGGVDIVDVDLNKCEPWDLPEAACVGGREWYFFSLRDRKYATGQRTNRATRSGYWKATGKDRAILAHGAGEASAALVGMRKTLVFYQGRAPKGTRTEWVMHEFRLEEERHHYHHQEQQKGRAATAEARCQLKEDWVLCRVFYKSRTTSPRPPSEEACTFFSELDLPTMPPLAPLIDAYIAFDSGTTMNTIQQVSCFSGLPALPLRGSVSFGDLLGWDNPDKKXIRTALSNMSSXSNSKLELPPNWSQENGXSQMWTPL

SEQ ID NO: 4616 - protein, 448 aa, Triticum aestivum
ILPVVTNQHLLLCTLLIGNSLAMEALPIFLDSLLPSFGAILISVTLILAFGEIMPQAICTRYGLSMGAKAAPIVRVLLVVFFPVAYPISKLLDWLLGKGHVALMRRAELKTLVDMHGDAAGKGGELTHDETTIIAGALEMTQKTAKDAMTPISETFSLDINAKLDVHTVGMIMTKGHSRIPIYSGRPSNIIGLILVKNLLTCRPEDEVPTRHVTIRKIPRVADDLPLYDILNEFQKGHSHMAVVVKRTKEGASVEKNNSFTADYKMTNGHAHADGLGLSPSHVNTPGSRRNNNDKYSKKIERKRDNILDFNTDPLPHYSMDEEAVGIITMEDVMEQLLQEDILDETDEYVDVHNKIKINMLPPGKSLSPLISPSGGPLSQGLRKTPMASPLSPYHNGGSILRSPAANHARSPGTLPTAFSPGRSPASQTPVRSSPTSSWVSRNSYRNP

SEQ ID NO: 4617 - protein, 518 aa, Oryza sativa
MSQHAVCCGAMFWVYLMSCVGLVMFAGLMSGLTLGLMSLSLVDLEVLAKAGTPTDKDNAARILPVVKNQHLLLCTLLIGNSLAMEALPIFLDSLVPSFGAILISVTLILAFGEIMPQAICTRYGLSVGAKAAPVVRVLLIVFFPVAYPISKLLDWVLGKGHVALMRRAELKTLVDMHGNEAGKGGELTHDETTIITGALEMTQKTAKDAMTPISETFSLDINAKLDLHTMGMIMTKGHSRVPIYSGTPNNIIGLILVKNLITCQPEDEVPIRNVTIRKIPRVSDDLPLYDILNEFQKGHSHMAVVVRRIKEPGASIEKTYSDRSDYKTNSDRSDYKINHRDAHADGLSPSRVSIAGSRRSNIEKNGEVRLYKKSEKKRDNILDFNSGPLPSYSLDQEAVGIITMEDVMEQLLQEDILDETDEYVDVHNKIKINMLPLGKSLSPTISPSNGPHSQGLRRTPMTSPLSSYHHGGSILRSPASNNPQSPGTLPTIISPERSPASQAPSRSSPNSTQVSRNS

SEQ ID NO: 4618 - protein, 520 aa, Sorghum bicolor
MPSHEACCGTMFWVYLMSCFGLVMFAGLMSGLTLGLMSLSLVDLEVLSKAGTPKDKRNAARILPVVKNQHLLLCTLLIGNSLAMEALPIFLDTLVPPYVAILISVTLILAFGEIIPQAICTRYGLSVGAKAAPVVRVLLILFFPVAYPISKLLDSLLGKGHFALMRRAELKTLVDMHGNEAGKGGELTHDETTIITGALELTQKIAKDAMTPISETFSLDINAKLDLHTMGMIMTRGHSRVPIYSGIPSNIIGLILVKNLITCRAEDEVPIRNVTIRKIPRVADDLPLYDILNEFQKGHSHMAVVVKRTKESGASTEKQKSTTADYKINPKDALADGSSPSSASAAGSRRINIEKHGDGRSYNKKSERKRENILDFNTDPLPCYSMDEEAVGIITMEDVMEELLQEEIYDETDEYVDVHNKIRINMLPPGKSLSPTISPGGGPLSQGLRRTPMASPFSPYHHGSSVLRSPASNHGQSPGILPTILSPGRSPTAQTPGQSSPSGSQVSINSNGQHKKDGES

SEQ ID NO: 4619 - protein, 520 aa, Zea mays
MASHEACCGTMFWVYLMSCVGLVMFAGLMSGLTLGLMSLSLVDLEVLAKAGTPKDKLNAARILPVVKNQHLLLCTLLIGNSLAMEALPIFLDTLVPPYVAVLISVTLILAFGEIMPQAICTRYGLSVGAKAAPVVRLLLILFFPVAYPISKLLDWLLGKGHFALMRRAELKTLVDMHGNEAGKGGELTHDETTIITGALELTQKIAKDAMTAISETFSLDINAKLDLHTMGMIMTRGHSRVPIYSGMPSNIIGLILVKNLITCRAEDEVPIRNLTIRKIPRVADDLPLYDILNEFQKGHSHMAVVIKRTKEAGVSTEKQKSTTADYKINPKDARADGSSPSYGSTAVSRRINIEKHGDGRPYNKKSERKRENILDFNNDPLPSYSMDEEAVGIITMEDVMEELLQEEIYDETDEYVDVHNKIRINMLTPGKSLSPAISPGGGPLSQGFRRTPMASPFSPYHHGSSVLRSPASNHGQSPGTLPTILSPGRSPTAQTPGQSSPNGSQVSINSNGQHKKDGES

SEQ ID NO: 4620 - protein, 222 aa, Triticum aestivum
MSSRVLLLIVAVAALVSACAADPEPVQDFCVAAATNGSADHPSYPGFPCKPASAVVSDDFFFAGLARSGAADAAESPFGSSVTSGNVAAFPGLNTLGVSINRVDLAPGGVNPLHSHPRAAELVHVVSGQMLVGFVSTAGTFYSKVVREGESFVIPRGMVHFQFNTGKESARAVTVFNSQLPGVVLAAPSLFGADPEIPDAVLSKSFQVDGEIIKLLKSKFRT

SEQ ID NO: 4621 - protein, 220 aa, Secale cereale
MPSPVLLLLAAVFVSACVADPEPVQDFCVAAVTNGSADHPSYPGFPCKPASAVVSDDFFFAGLARSGAADAAESPFGSSVTSGNVAAFPGLNTLGVSINRVDLAPGGVNPLHSHPRAAELVHVVTGQMLVGFVSTAGTFYSKVVREGESFVIPRGMVHFQFNTGREAARAVTVFNSQLPGVVLAAPSLFGADPEIPDAVLAKSFQVDGEIIKLLKSKFRD

SEQ ID NO: 4622 - protein, 210 aa, Triticum aestivum
MAVNDTKLADAENPGAMCRGGGGGIDSDSDVDFAGRANWLRAAVLGANDGLVSTASLMLGVGAVKHEVRAMVISGFAGLLAGACSMAIGEFVSVCSQRDVEIAQLDRDGKRGGDEERALPSPVQAAAASALAFSVGALLPLLAAGFIVGYKLRVAVVVAVATLALAAFGVVGAVLGRAPVVRSSARVVVGGLAAMGLTFGLMRLFRASGI

SEQ ID NO: 4623 - protein, 182 aa, Secale cereale
LRRGLGGPRQLAARGGAGRQRRAGVHGVAHAGRGRREARGARHGDLRVRGPAGGACSMAIGEFVSVCSQRDVEIAQLDRDGKRGGDEERALPSPVQAAAASALAFSVGALLPLLAAGFIVGYKLRVAVVVAVATLALAAFGVVGAVLGRAPVVRSSARVVVGGLAAMGLTFGLMRLFRASGI

SEQ ID NO: 4624 - protein, 210 aa, Triticum aestivum
MAVNNTKLAAVADAENPAVVCGDVDDSESSIDFAGRANWLRAAVLGANDGLVSTASLMLGVSAVKPEARAMVVSGFAGLLAGACSMAIGEYVSVCSQRDVEIAELDQAGKRGGDEEKALPSPAQAAAASALAFSVGALLPLLAAGFIVGYNLRVAVVVVVATLALAAFGCVGAVLGRAPVARSCARVVVGGLAAMAVTFGFMRLFRASGV

SEQ ID NO: 4625 - protein, 204 aa, Festuca arundinacea
  misc_feature (134)..(134): Xaa can be any naturally occurring amino acid
MAVSDTKLADAENPTATKFGDDSDVNFAGRANWLRAAVLGANDGLVSTASLMLGVSAVKHDVRAMVVSGFAGLLAGACSMAIGEYVSVCSQRDVELAQLDRDGKRGGDEERALPNPVQAAVASALAFSVGALLXLPAAGFIVGYRLRVAVVVAVATMALAAFGYVGDVLGWAPITRSCARVVVGGFAAMGVTFGLMRLFRELAE

SEQ ID NO: 4626 - protein, 210 aa, Secale cereale
MAMNNTKLAAVADAENPAVVCGDVDDSESSIDFAGRANWLRAAVLGANDGLVSTASLMLGVSAVKPDARAMVVSGFAGLLAGACSMAIGEYVSVCSQRDVEIAQLDQAGKRGGDEEKELPSPAQAAAASALAFSVGALLPLLAAGFIVSYNLRVAVVVLVATLALAAFGCVGAVLGRAPVARSCARVVVCGLAAMAVTFGFMRLFRASGV

SEQ ID NO: 4627 - protein, 200 aa, Secale cereale
VADAENPAVVCGDVDDSESSIDFAGRANWLRAAVLGANDGLVSTASLMLGVSAVKPDARAMVVSGFAGLLAGACSMAIGEYVSVCSQRDVEIAQLDQAGKRGGDEEKELPSPAQAAAASALAFSVGALLPLLAAGFIVGYNLRVAVVVLVATLALAAFGCVGAVLGRAPVARSCARVVVGGLAAMAVTFGFMRLFRASGV

SEQ ID NO: 4628 - protein, 146 aa, Lolium multiflorum
ACRYPGIRPLRPGAGRGGDAGGGDSLPRRAWKQYLLQLQLQLHPLRTKMITARCLAGVSDSVAQKLSGYQTIEKRRLLLKMMFGFAHGGPFGHFLHKVLDYIFKGKKDSRTVAKKVLLEQITSSPWNNLLSYSIMDMLSRRGLSRR

SEQ ID NO: 4629 - protein, 465 aa, Sorghum bicolor
YSGAPNYGGTYGGHGGPPPFGTSDSQGGQPPFGYDPQVKFYKLEFPTYDGTVDPLNWLNQCDQFFCGQRTPASNRTWLVSYHLRGGAQTWYYALEQDEGMPPWERFRDLCRLRFGPPLHGSRLAELGRLPFATSVQEFADRFQALACHAPDVSTRQRAELFVGGLPEYIRVDVEMHHPQDLQVAIYYARAFERRAAATPPVPPARPTRPAQRPGLPAARAPGAGPAAVPPAAGAGAPGGRAFRRLTPAEQQERRRQGLCYNCDELYTPGHMCQRLLYLAADDYIEEAVQPQGDAAAPALQEAAAPEEEVANVLAVSLHAFAGIRTTNTMLLPVLIKGECVLALLDTGSTHNFLSGAIMERLGLVPDGGDQLRVTVANGDKLRCAGIARNVPISIEGETFAITCAGIDLGCFDFILGYDFLRTLGPITWDLEAKTMAFWRGGRGIQWQGVGGADTPAPPSRPRRLL

SEQ ID NO: 4630 - protein, 244 aa, Secale cereale
MMPSANCAELIGNDRLRDDDEEQLRWEFAPPSSVPPTQIWDFNLGRSRNHNEKSAHEVGFGSNNGGFMIKSYSDMLKEISCGTTKDLEDIYDSGYGAAAEDIMSTNICQVPSKNVSTASNKRMKVSSCTSTMDGPTTSGSHVPASGTLGSSSHDRGAAPAREISFGDQTIVPTGAERPAARIDSETLALNRDSAMQRYKEKRKNRRYEKHIRYESRKLRADTRKRVKGRFVKSNEALNAGSNGG

SEQ ID NO: 4631 - protein, 363 aa, Triticum aestivum
CGLGGGGDQEDEDAFFFSSLDYSMLVDPEMRDLYVPCNPPEVAVSAGGGRPLKGEALCHQLAEMARRETETSQPQGYSDLSPRTPRRSSAGASGRLPDKQAPPPLPPAPEVPCPYTSLLMMPSAHCAELIGNDRLRDDDEEQLRWEFAPPSSVPPTQIWDFNLGRSRNHNEKSAHEIGFGSNNGGFMIKSYSDMLKEISCGTTKDLEDIYDSGYGAAAEDIMSTNICQVPSKNVSTASNKRMKVSSCTSTMDGPTTSGSHVPASGTLGSSSHDRGAAPAREISFGDQTIVPTGPERPAARIDSETLALNRDSAMQRYKEKRKNRRYEKHIRYESRKLRADTRKRVKGRFVKSNEALNAGSNGG

SEQ ID NO: 4632 - protein, 523 aa, Triticum aestivum
MAPAAKKPPLKSSSSHNSAAGDAAGKTIEEMYQKKTQLEHILLRPDTYVGSVQNHTQTLWVYEDGAMVNRPVSYVPGLYKIFDEILVNAADNKQRDPSMDSLKVDIDVEGCCISIYNNGDGVPVEIHQEEGVYVPELIFGHLLTSSNYDDNERKTTGGRNGYGAKLANIFSTEFVIETADGHRLKRYRQVFSENMGKKSEPEIKKCKQSENWTRVTFKPDLAKFNMTELEADVVALMRKRVVDMAGTLGKTVKVELNGEKVAVKSFSDYVQLYINSASKEGIDLPRIYQKINDRWEVCVSLSEGQFQQVSFVNGIATIRGGTHVDYVANQVASHVMGVVNKKNKQANMKLHTVKGYLWVFVNALIDNPAFDSQTKETLTTRQASFGSTCELSDEFLKKVSSSGVVNNLLSWAEFKLSKELKKTDGTKKTSIVGIPKLEDANDAGGKNSDKCTLILTEGDSAKALAMAGIGVVGRDHYGVFPLRGKLLNVREASHKQLMENAEIQNIKKILGLQHEKSMIARKA

SEQ ID NO: 4633 - protein, 1252 aa, Secale cereale
MGKKSEPEIKKCKQSENWTKVTFKPDLAKFNMTELEADVVALMMKRVVDMAGTLGKTVKVELNGEKVAVKGFSDYVQLYIDSASKEGIELPRIYQKVNDRWEVCVSLSEGQFQQVSFVNGIATIRGGTHVDYVTNQIASHVMGVVNKKNKQAHMKLHTVKGYLWVFVNALIDNPAFDSQTKETLTTRQASFGSTCELSEEFLKKVSSSGVVNNLLSWAEFKLNKELKKTDGTKKTSIVGIPKLEDANDAGGKNSDKCTLILTEGDSAKALAMAGIGVVGRDHYGVFPLRGKLLNVREASHKQLMENAEIQNIKKILGLQHEKKYDSTKGLRYGHLMIMTDQDHDGSHIKGLLINFIHKEWPSLLKVPSFLVEFITPIIKATKGKAVKAFYSMPDYEAWKESLGGNASSWTIKYYKGLGTSTAQEGRDYFEDITHHKKDFVWADDKEDGEAIELAFSKKKIAERKDWLTNYQPGTCLDQREKRIKYSDFINKELILFSMADLERSIPSMVDGFKPGQRKILFCSFKKNLVKESKVAQFIGYVSEHSAYHHGEQSLASTIIGMAQDFVGSNNINLLEPRGQFGTRNAGGKDAASARYIFTRLQPITRLIFPKDDDVLLNYLNEDGQSIEPSWYMPIIPMVLVNGSEGIGTGWSTYVPNYNPRDIIANLKRLLNNETIVPMIPWYRGFKGSLKETSSKATGVTYTITGVIEEVADTRLKITELPVRRWTTDYKEFLESMCPIPIKEKEKSKDKNKEKKKDKDKDKEKEKEKSKEPPLLEEIRSQCDHADVDFELILTEQNMNVAKQEGLEKKFKLTTTIGTTNMHLFDSNGKIRKYDTPEDVLKEFFDLRLDFYVRRKKVMLENMGIELLKYKNKVRFILAVISGDIIVNNRKRAELFLELREKKYDPFPKKKPTSEPVAVGSTEVDEENDESPVEAAASDYEYLLAMSIGTLTMEKVKELIAQQDKVEDDLKILSNTEPETLWLRDLDALEKELDVLDAKLEAEQKDRSCKRAKNAKESNAAAKRQPKKAAAKSQKAGSDDQDFEPPKPKPAAQKKKAPPKKASAPVKDDEDDELANLKDRLAAYNLDDSSPEPSAMETEEQQKAKKGRNGASKRGAAKKAMSSLAESSDEDMAEPEDGGSSMEVEKKTKGRKPAAEKPKATTIRKRAPAQSKGMRQKVMEEILKPTDDSNLSAPSPEKKVRRMRDSPFNKKSGSLLQRAAGASTGAEDAEAPPPAALPRQLHREGPQGRGRWQ

SEQ ID NO: 4634 - protein, 1494 aa, Brachypodium distachyon
MAAAAKKPPLKSSSSHNSVAGGGAGKTIEEMYQKKTQLEHILLRPDTYIGSVEKHTQPLWVYDDGAMVHRPVTYVPGLYKIFDEILVNAADNKQRDPKMDSLRVFIDVEGCCVSVYNNGDGIPVEIHQAEGVYVPEMIFGHLLTSSNYNDNEQKTTGGRNGYGAKLTNIFSTEFTIETADGHRQKKYKQVFSENMGKKSEPEISKCKQSENWTRVTFKPDLAKFNMAHLEDDVVALMKKRVVDMAGTLGKTVKVELNGQKVPAKSFLEYVNLYIDSASKDGVKLPSIYQKVNDRWEVCVSLSEGQFQQVSFVNGIATIRGGTHVDYVANQIATHVMAVVNKKNKQANMKLHTVKGYLWVFVNALIDNPAFDSQTKETLTTRQGSFGSKCDLSDDFLKKVADSGVVSNLLSWADFKLSKELKKTDGSKRSNVLGIPKLEDANDAGGRDSDKCTLILTEGDSAKALAMAGRGIVGNDHYGVFPLRGKLLNVREATHKQMMENAEIQNIKKIIGLQHGKEYNSTKDLRYGHLMIMTDQDHDGSHIKGLLINFIHSSWPSLLKVPSFLVEFITPIIKATNKRSKSVISFYSMPDYEAWKERLGANASAWSIKYYKGLGTSTADEGREYFEKIAHHRKDFVWADDKDGDAIELAFSKKRIADRKDWLSNYQPGTCLDQREKRIKYSDFINKELILFSMADLERSIPSMVDGLKPGQRKILFSSFKRNLVKEIKVAQFIGYVSEHSAYHHGEQSLASTILGMAQDYVGSNNISLLEPRGQFGTRNSGGKDAASARYIYTRLPSITRIIFPKDDDVLLNYLNEDGQSIEPTWYMPIIPMVLVNGSEGIGTGWSTYTPNYNPRDIVANLKRLLNDDPIVPMDPWYKGFKGSFEKTTTKAAGVTYTISGIIEAANDTKLIISELPVRRWTLDYKEFLLSMCPQSVKEKEKEKDKNKNKSKDKDKDKDKNKEKEPPFLEDLRSQCDDSSVYFELTLSEKNMAIAMQEGLEKKFKLTNTMGTTNMHLFDSNGKIRKYDTPEEILQEFFTLRLEFYGRRKITMLKNMRVELLKLENRVRFIRSVISGDIKVNNRKRAELFLELKEKNFDAFPKKKNKTEPVAVGAEEEDEENEESPAEDTDGVLGGDYEYLLSMAIGTLTLEKVKQLIAQKDNLVNEVERLSKTDPKSLWVKDLDALEKELDVLDAELKAAEEKRRLAREKSTKDGKASKAAPKRQPKKTAAKSQKANLAGSDDEDYVAAIPKPAAQKKKPAKKASAQVKDAEDEILELKDRLAASNLDSSPEHIDMETETTEGPEKGKKGVDEPSNRGAAKKAMSSLADWSDEEDLTAPIHESEDEGFAMEEVQVEKKTRGRKPAAEKSKPAVRKRAPAQSKGMRQKVMEEIFKPTDDSTTSAPSPVKKVRKMRASPFNKKSGSVFQRVAGASTGTEDTDAPQSGSSAEPVAPRRTARERKAKAIYIDSASDNDDSEDEDVQDLSDESDFDEDED

SEQ ID NO: 4635 - protein, 844 aa, Triticum aestivum
DPSMDSLKVDIDVGGCCISIYNNGDGVPVEIHQEEGIYVPELIFGHLLTSSNYDDNERKTTGGRNGYGAKLANIFSTEFVIETADGHRQKRYRQVFSDNMGKKTEPEIKKCKQSENWTKVTFKPDLAKFNMTELEADVVALMMKRVVDMAGTLGKTVKVELNGEKVAVKGFSDYVQLYIDSASKEGIELPRIYQKVNDRWEVCVSLSEGQFQQVSFVNGIATIRGGTHVDYVANQIASHVMGVVNKKNKQANMKLHTVKGYLWVFVNALIDNPAFDSQTKETLTTRQASFGSTCELSEEFLKKVSSSGVVSNLLSWAEFKLNKELKKTDGTKKTSIVGIPKLEDANDAGGKNSDKCTLILTEGDSAKALAMAGIGVVGRDHYGVFPLRGKLLNVREASHKQLMENAEIQNIKKILGLQHDKKYDSTKGLRYGHLMIMTDQDHDGSHIKGLLINFIHKEWPSLLKVPSFLVEFITPIIKATKGKAVKSFYSMPDYEAWKESLAGNASSWTIKYYKGLGTSTAQEGRDYFEDITHHKKDFVWADDKEDGEAIELAFSKKKIAERKDWLTNYQPGTCLDQREKRIKYSDFINKELILFSMADLERSIPSMVDGFKPGQRKILFCSFKKNLVKESKVAQFIGYVSEHSAYHHGEQSLASTIIGMAQDFVGSNNINLLEPRGQFGTRNAGGKDAASARYIFTRLQPITRLIFPKDDDVLLNYLNEDGQSIEPSWYMPIIPMVLVNGSEGIGTGWSTYVPNYNPRDIIANLKRLLNNETIVPMVPWYRGFKGSLKETSSKATGVTYTITGVIEEVADTRLKITELPVRRWTTDYKEFLESMCPIPIKEKE

SEQ ID NO: 4636 - protein, 406 aa, Triticum aestivum
NGDGVPVEIHQEEKIYVPELIFGNLLTSSNYDDNERKTTGGRNGYGAKLANIFSTEFVIETADGRRQKRYKQVFSENMGKKSEPEIKKCKQSENWTKVTFKPDLEKFKMTELEADVVALMMKRVVDMAGTLGKTVKVELNGEKVAVKSFSDYVQLYIDSASKEGIKLPRIYQKVNDRWEVCVSLSEGQFQQVSFVNGIATIKGGTHVDYVASQIASHVMGVVNKKNKQANMKLHIVKGYLWVFVNALIDNPAFDSQTKETLTTRQGSFGSTCELPEDFLKKVSSSGVVDSLLSWAEFKLSKELKKTDGTKKTSIVGIPKLEDANDAGGKNSDQCTLILTEGDSAKALAMAGIGVVGRDHYGVFPLRGKLLNVREASHKQLMENAEIQNIKKILGLQHEKSMIARKA

SEQ ID NO: 4637 - protein, 1525 aa, Oryza sativa
MAAAAARLPLQSSSGHNAAAGGGGGKTIEEMYQKKTQLEHILLRPDTYIGSVEKHTAQLWVYEDGAMVSRSVTYVPGLYKIFDEILVNAADNKQRDPSMDSLRVEIDADEGRISVYNNGDGIPVEIHQEEGVYVPEMIFGHLLTSSNYDDNVKKTTGGRNGYGAKLTNIFSTEFVIETADGRRQKKYKQVFSENMGKKSEPQITKCKQGENWTRVTFKPDLAKFNMTHLENDVVALMRKRVVDMAGTLGKTVKVELDHQKVPVHSFSDYVKLYIKSASKDRDDVNELPSISQKVNDRWEVCVSLSEGQFQQVSFVNRIATIKGGTHVDYVTNQIATHVMNIVNKRNKNAHMKAHNVKSHLWVFVNALIDNPAFDSQTKETLTTRQASFGSKCELSDDFLKKVGSSAIVLNLLSWAEFKLSKELQKTDGSKRSRLTGIPKLEDANGAGGKDSNNCTLILTEGDSAKALAMAGISVVGRDYYGVFPLRGKLLNVREASHKQIMENAEIQNIKQILGLQHGKQYDSTKGLRYGHLMIMTDQDHDGSHIKGLLINFIHSFWPSLIKIPSFLVEFITPIIKATNKRDKKIVLPFYSMPEYEQWKESLGGNASGWSIKYYKGLGTSTSSEGRQYFQDIAKHKKDFVWKNDQDDNDIELAFSKKRITDRKEWLTNFQSGTHLDTEGKYIKYSDFINKELIQFSMADLLRSIPSMVDGLKPGQRKILFCSFKRNLVKEIKVAQFSGYVSEHSAYHHGEQSLASTITGMAQDFVGSNNINLLQPNGQFGTRDQGGKDAASARYIFTLLSPITRSIFPKDDDILLNYLDEDGQSIEPTWYVPILPMVLVNGSEGIGTGWSTFIPNYNPRDIVANLRRLLNDEPVEPMDPWYRGFKGSIQKTGTKAGGVSYTVTGIIEVVDDTTLRITELPIRRWSQDYKEFLISIGGTDKSKDKDKDKGKGKGKVKEKEKKEKDIEPFIEAFDTYSDDKNVEFLITLSKENMAIALQEGLEKKFKLTTTIGTTNMHLFDSNGKIRKYDTPEDILKEFFGLRLEFYEKRKRVLLENIELELKKLSNKVRFILAVVEGDIIVNNRKRAELFVELKQKGFDPFPRKKQRAGPSAVGAIEEDEENEESPEAANVGSSDYEYLLSMAIGTLTLERVQQLIAEKGRMENEVAELKRTRPKSLWMRDLDAFEKELDALDEKDSMDAEERRATRNAGGGAAPNKAAPKRRPRKTATNTQAAESSDGNAAAPAVPKPAAPRKKPAGKASLADSEDEDYIAAIPKPAAQKKQPAKKASTQLSDDEDDEVLALKDRLAAYNLDDHSEDTAMETETTEEQAKGKKGRKEPSKRGAAKKAISSLAVISDDEEDETVPIDEDDEDDFAMEEVPVKKGRGKKPAAEKPKAATRKRAPAQGKSMRQKVMEEMFKPTEDSSTSAPSPEKKVRKMRASPFHKKSGSVLQRASTASTSTEETESSSPSGSSAEPVAARPKRQTRGNKKSYQEVQELSDDDTEDEVQDISDDSDFAGSDFGEDDD

SEQ ID NO: 4638 - protein, 1412 aa, Zea mays
MAAPLHSSSGHNAAAGGGAKTIEEMYQKKTQLEHILLRPDTYIGSVEKHTQALWIYEDGAMVNRSVTYVPGLYKIFDEILVNAADNKQRDPKMDALRVEIDVDSCCISVYNNGDGIPVEVHQEEGVYVPEMILGHLLTSSNYNDNEKKTTGGRNGYGAKLTNIFSTEFVIETADGRRQKKYKQVFYENMGKKSEPQITKCKQGENWTRVTFKPDLAKFNMTHLEDDVVALMRKRVVDMAGTLGKTVKVELDGQRVPIKSFCDYVDLYMKSANCDRPDNFKRIYEQVNDRWEVCVSQSEGQFQQVSFVNRIATIRGGSHVDYVTNQIANHVVAIVNKKNKNANMKLHNVKSHLWVFVNALIDNPAFDSQTKETLTTRQGSFGSKCELSSDFLKKVEKSGVIENVLSWADFKLSKELKKTDGSKKSRISGIPKLEDANEAGGKDSDKCTLILTEGDSAKALAMSGIAVVGRDYYGVFPLRGKLLNVREANHKQIMDNAEIQHIKQILGLQHGKQYESTKGLRYGHLMIMTDQDHDGSHIKGLLINFIHSFWPSLLKVPSFLVEFITPIIKATRGQTTKSFYTMPEYEEWRKNLGASASSWTIKYYKGLGTSTAKEGRKYFEDIIDHKKDFVWVDDQDGNHIELAFSKKRIADRKQWLTNFQPGTYIDQREKQVKYSDFINKELILFSMADLQRSIPSMVDGLKPGQRKILFCSFKRNFVKEAKVAQFSGYVSEHSAYHHGEQSLASTIIGMAQNFVGSNNINLMSPNGQFGTRAQGGKDAASPRYIFTKLSNITRSIFPKDDDILLNYLNEDGQSIEPTWYMPILPMVLVNGSEGIGTGWSTYIPNYNPRDIVANVRRLLNEESTVPMHPWYRGFKGSIEKTVNTKVAGSTYTVTGIIEVVDNTTLRITELPIRRWTQDYKDFLESLAPDPKNKDKVTFIEDVTSQGDNEDVYIQLKLSEANVNVAKEEGLVKKFKLTTTIGTTNMHLFDSDGKIRKYDTPEQILEEFFQLRLEFYCKRKEALLKNIKLDLKKLENKVRFIRCVVDNEIIVNNRKRADLFLELRHKNFDPFPKKKKKAEPTAVGAIEEEENEESPETAAGVDPSDYEYLLSMSIGTLTLEKIQELNAEKQKLVDDVVELMNTSPKSLWLKDLDAFEKELDVLDQMDLAEEVQREKRIKEGKKGGSKAAPKKQPKKAAPIKLESSTEDNAAEPVVAKRGAQQKKAPKKAPVDEEEVDMPSLKDRLAAFNINDSSPPDHSAMETETTEQPAQKKGRGKKPAAAAVKPKAPAARKRAPTQGGKATQKKIDEMLKVTEDNTSSALSPEKKVRKMRPSPFNKKSGSILQRGSTAASASSETIAEASPPSGSSEEPVAAAKPRRTARATKKHVYISESDPEDEVVELSDDSDFDLDADSD

SEQ ID NO: 4639 - protein, 1480 aa, Setaria italica
MTGPLHSSSGHNAAAGGGGGGKTIEEMYQKKTQLEHILLRPDTYIGSVEKHTQTLWVYEGGAMVNRAVTYVPGLYKIFDEILVNAADNKQRDPRMDSLKVEIDVEGCCVSVYNNGDGIPVEVHQEEGVYVPELIFGHLLTSSNYNDNEKKTTGGRNGYGAKLTNIFSTEFVIETADGRRQKKYKQVFSENMGKKSEPQITKCKQGENWTRITFKPDLAKFNMTHLEDDVVALMRKRVVDMAGTLGKTVKVEMDGQRLPVKSFSDYVNLYIKSTNGDPKLRVFDQVNDRWEVCVIPSEGQFQQVSFVNRIATIRGGTHVDYVTNQVANHVMTVVNKKNKNANMKLHNVRNHLWVFVNALIDNPAFDSQTKETLTTRQGSFGSKCELSNEFLKGVEKSSIVSNVLSWADFKLSKELKKTDGSKKSRISGIPKLEDANEAGGKDSNKCTLILTEGDSAKALAMAGIAVVGRDHYGVFPLRGKLLNVREANHKQILDNTEIQNIKQILGLQHGKQYDSTKGLRYGHLMIMTDQDHDGSHIKGLLINFIHSFWPSLLKVPSFLVEFITPIIKATKKNETKSFYTMPEYEDWKRNLGASASSWTIKYYKGLGTSTSKEGKDYFTNIDQHKKDFVWVDDQDGNEIELAFSKKRIADRKEWLTNFQPGTYLDQREKEIKYRDFINKELILFSLADLQRSIPSMVDGFKPGQRKILFCSFKRNLVKETKVAQFSGYVSEHSAYHHGEQSLASTIVGMAQSFVGSNNINLLYPGGQFGTRSQGGKDAASPRYIFTKLSHITRSIFPKDDDTLLNYLNEDGQLIEPSWYVPILPMVLVNGSEGIGTGWSTFIPNYNPRDIAANIRRLLNDEATVPMHPWYRGFKGSIQKANNARVDGATYTITGIIEAVDSTTLRITELPVRRWTQDYKDFIDSLRPDEKNKDKEAFIEDCTAQGDNDDVYFELKLSEKNMNIAKEEGLLKKFKLTTTIGTTNMHLFDSDGKIRKYDTPEQILEEFFKLRLQFYFKRKEVLLQNMKLDLKKLENKARFIRCVVNNEIVVNNRKRADLFLELRQKNFDPFPKKKKRAEPAAVGATEEEENEESPEAANGVDPSDYEYLLSMAIGTLTLEKIQELNAEKEKVVNEVEELEKTTEKSLWLRDLDAFEKDLDVLDQMDLADAQERKRLRDENAKKAGSKAAPKKQRKKPAAKQPKVESDTEGDAAEPVVAKRGAQRKKPAKENGAGSDDEDYVAEKAKAEQQKKKQSKKASAPPVDEDEDDLPTLKERLAAFNLNDSSPDNSAMETETTEEQIGGKGKKGVSKRGGGKKASSSLAVIHDDEDEDVDVSLEVPEEVQGPKKGRGRKPAAPVKPKATATRKRAPAQGKAMMLKPTEDSNTSAPSPEKKVRKMRESPFNKKSGSILQRGSIAASTSSESTAEASPPSGSSAEPIAAPQPRRTARATTKKTPVYDLESEDEVVEVTDDSDFDVDGDSDE

SEQ ID NO: 4640 - protein, 1452 aa, Sorghum bicolor
MAGPLHSSSGHNAAAGGGGKTIEEMYQKKTQLEHILLRPDTYIGSVEKHTQPLWVFEDGAMVNRSVTYVPGLYKIFDEILVNAADNKQRDPKMDALRVQIDVDGCCISVYNNGDGIPVEIHQEERVYVPEMIFGHLLTSSNYNDNEKKTTGGRNGYGAKLTNIFSTEFVIETADGRRQKKYKQVFSENMGKKSEPQITKCKQGENWTRVTFKPDLAKFNMAHLEEDVVALMRKRVVDMAGTLGKTVKVELDGQRVPIKSFSDYVNLYMKSANCDRPDNFKTIYENNDRWEVCVCQSEGQFQQVSFVNRIATIRGGTHVDYITNQIANHVMTVVNKKNKNANMKLHNVKSHLWVFVNALIDNPAFDSQTKETLTTRQGSFGSKFELSIDFLKKVEKSSIIENVLSWADFKLSKELKKTDGSKKSRISGIPKLEDANEAGGKDSEKCTLILTEGDSAKALAMSGIAVVGRDYYGVFPLRGKLLNVREANHKQIMENAEIQNIKQILGLQHGKQYASAKGLRYGHLMIMTDQDHDGSHIKGLLINFIHSFWPSLLKVESFLVEFVTPIIKATRGKTTISFYTMPEYEEWRTNLGASASSWTIKYYKGLGTSTAKEGREYFKDITDHKKDFVWEDDQDGNHIELAFSKKRIADRKLWLTNFQPGTYIDQQEKRVRYSDFINKELILFSMADLQRSIPSMVDGLKPGQRKILFCSFKRNFVKEAKVAQFSGYVSEHSAYHHGEQSLASTIIGMAQNFVGSNNINLMFPGGQFGTRAQGGKDAASPRYIFTKLSHITRSIFPKDDDILLNYLNEDGQSIEPTWYMPILPMVLVNGSEGIGTGWSTFIPNYNPRDIVANLRRLLNEESTVPMHPWYRGFKGSIEKTVNTKVVGSTYTVTGIIEVVDNSRLRITELPIRRWTGDYKEFLESLGPDKNKDKVPFIEDVTAQGDNEDIYIEIQLSEGNMNIAKEEGLVKKFKLTTTIGTSNMHLFDSNGKIRKYDTPEQILEEFFQLRLEFYVKRKEALLKNIKLELKKLENKVRFIRCVVDNEIIVNNRKRADLFLELRQKNFDPFPKKKKRAEPAAAGALEEENEENPEAEAAEPSDYEYLLAMPIGTLTLEKIQELIAEKQKLVDDVEELKNTSPKSLWLKDLDAFEKELDLLDQMDLSEEEQREKRIKDGKKGRSKAAPKKQQRGKKAGSKAAVKKEKSDTEDDDAAEPVVPKRGGQQKKAPKKAPVDEEEFDIPALKDRLADFNINDSSPDYSAMETEITEEQNEKLATKGPSKRGGGKKAVSSSLVMIQSDDEDDDFTLEEVSEVQAQKKGRGKKPAAAVKPKAPAPRKRAPAQGKATQKKIDEMLQGIEDNNTSPEKKVRKMRPSPFNKKSGSILQRGSTAASSETTAEASPPSGSSAEPVGAAQPRRTARATKKPVYVTDSDPEDEVVELTDDSDFDVDGDSDE

SEQ ID NO: 4641 - protein, 1482 aa, Panicum virgatum
MTGPLHSSSGHNAAAGGGGGKTIEEMYQKKSQLEHILLRPDTYIGSVEKHTQTLWVYEVGAMVYRSVTYVPGLYKIFDEILVNAADNKQRDPRMDSLRVEIDVEGCCISVYNNGDGIPVEVHQEEGVYVPEMIFGHLLTSSNYNDNEKKTTGGRNGYGAKLTNIFSTEFVIETADGRRQKKYKQVFSENMGKKSEPQITKCKQGENWTRVTFKPDLAKFNMTHLEDDVVALMRKRVVDMAGTLGNTVKVQLDGQKLSVKSFSDYVDLYMKSANSDRPDALKKAHEYVNERWEVCVTQSEGQFQQVSFVNGIATIRGGTHVDYIANQIANYVMTIVNKKNKHANMKAHNVKSHLWVFVNALIDNPAFDSQTKETLTTRQGSFGSKCELSPKFFKDVEKIGVVSNVLSWADFKLSKELKKTDGSKKSRISGLTKLEDANEAGGKDSDKCTLILTEGDSAKALAMSGIAEVGRDHYGVFPLRGKLLNVREASHKQIMDNAEIQNIKQILGLQHGKQYDSTKGLRYGHLMIMTDQDHDGSHIKGLLINFIHSFWPSLLKVPSFLVEFTTPIIKATKNNKTQAFYTIPEYEEWKRKLGASASSWTIKYYKGLGTSTSKEAKEYFSDIGNHKKDFVWVDDQDGNEIELAFSKKRIADRKQWLTNFQPGTYLDHKEKKIKYRDFINKELILFSMVDLQRSIPSMVDGFKPGQRKILFCAFKRNLVKETKVAQFSGYVSEHSAYHHGEQSLASTIVGMAQSFVGSNNINLFFPGGQFGTRCQGGKDAANARYIFTKLSHITRSIFPKDDDILLNYLNDDGQSVEPSWYVPILPMVLVNGSEGIGTGWSTYIPNYNPRDIVANLRRLLNDESTVPMHPWYRGFKGSIVKSHNAKVAGATYTITGIIEAVDSTTLRITELPIRRWTQDYKDFIDSVTFDPKDKDKETFIEEFTMQGDSDDVYFVLKLTEDNMNKVMEEGLVKKFKLTTTIGTSNMHLFDSDGKIRKYDTPEQILEEFYKLRLEFYVNRKKALLQNIKLDLKKHENKIRFIRCVVDNEIVVNNRKRADLFLELREKNFDPFPKKKKKAEPAAVGATEEEENEEESPEAANGVGPSDYEYLLSMAIGTLTLEKIQELNAEREKLMKDVEELENTAPKSLWLRDLDTLEKELDVLDQIDLADEEERRKKREKNTNKGLKAAPKKQRKNAAVQLPKVESDTEGDGAEPVVAKRGAQRKKPAKKVNGAGSDDEDYVAENAKPEHQKKKQTKKASAPVDEDDMPTLKDRMAAFSINDFSPDSSALETETTEDQNEDKGPNGPSRRGRVKKGLSSLAVISDDEDDDVDFAMEVPEVQVEKKGRGRKTDAAATKPKAAATRKRAPAQGKAMMLKPTEDSNTSAPSPEKKVRKMRESPFNKKSGSILQRASTAAASSSETTAEASPPSGSSAEPAAAPQPRRTARATTSKPVYISESDPEDEVVELTDDSDFDVDGDSDDE

SEQ ID NO: 4642 - protein, 288 aa, Sorghum bicolor
MQIRLDGKNCLVTGANSGIGFATAEGLASHGATVYMLCRNKERGEAALDQIRSKTGNANVHLEICDLSSINEVKSFATKFTSMDKPLHVLVNNAGLLEHKRETTAEGLELNFAVNVAATYTLTELVMPLLEKAAPDARVITVASGGMYTEPLNKDLQFTEGTFDGTQQYARNKRVQVALTEWWAEKYGNKGVGFYSMHPGWADTPGVAKSLPGLSEKLSGNLRTNDEGADTVVWLALQPKEKLASGAFYFDRAEAPKHLKFAGTAASHAQINSIVHSIRSICGFSVKG

SEQ ID NO: 4643 - protein, 206 aa, Panicum virgatum
MDKPLHVLVNNAGLLEHKRETTAEGLELNFAVNVAATYTLTELVMPLLGKAAPDARVITVASGGMYTEPLNKDLQFSEGNFDGTLQYARNKRIQVALTEWWAEKYNNKGVGFYSMHPGWADTPGVAKSLLGFSEKLSGNLRSNDEGADTVLWLALQPKEKLSPGAFYFDQAVAPKHLKFAGTMSSHSQIKSIVDSIRSICGLPALG

SEQ ID NO: 4644 - protein, 493 aa, Oryza sativa
MAPTPPSRPRLPLRPLLLSLPLLSLLLLLLIHRPHPSPPPPLLATATATRRDDEPAPRRAASSLAPKATTTTTLAHVVFGIASSRRTLPLRLPLLRLWLRPPARAFLFLDGPAPAAAAASEPLPPNLRFCVSSTDASRFPYTHPRGLPSAVRVARIAKELLQLDDHHHATPPPPRWLVLADDDTAFVLPNLLHTLSRYDWREPWYLGARSESAAQNAWHGFAMAYGGGGIAVSWPLAARLARVLDSCLLRYPHLYGSDARIHACLAELGVELTHEPGFHQIDLHGDISGLLRAHPLTPLVSLHHLDHVYPLYPGMDRATAVKHFFRAANADPARILQQTVCYDHSKAITVSIAWGYSVQVYKGNVLLPDLLAVQKTFVPWKRGRNATDVFMFDTKHYPRDECKRAALFFLKSISSGEGKIKSDYTRQLPRKCSPNLIPLRNLHQIKVASEPLHLVPGKALRRHCCDVVSSSSETNMDVNIRKCKEDELIAMHS

SEQ ID NO: 4645 - protein, 497 aa, Brachypodium distachyon
MATPSHGLPFAPLRALLIALPLLSLLLLLHHHLLPSRHTPSPSTPPPLTPSLAVHAPLRAAIHRAAKAGGPSSSPATKKTTLSHVVFGVASSRRTLPLRLPLLRLWLRPPARAFLFLDGPPSAAHPSPLPPNLHLRVSRDASRFPYSHPRGLPSAVRVARIASDLLLDLKQGQGNSPPPRWLVLADDDTAFVLPNLLHTLAKYDWREPWYLGARSESAAQNTWHGFAMAYGGGGVAVSWPLAARLARVLDSCLLRYPHLYGSDARIYACLAELGVELTHEPGFHQIDLHGDISGLLRAHPLAPLVSLHHLDHVYPLYPGMDRAKAVEHFFRAANADPARILQQTVCYDQSRSLTASVAWGYSVQVFRGNVLLPDLLAVQKTFVPWKRGRNVTDVFMFNTKHYPRDECKRAALFFLKSISSGEGKTESNYSRQLPRKCLPRLIPLRNLHQIKVTSDLLHLVPGKALRRHCCDIIPSPEITMDINIRKCKDNELIVMHS

SEQ ID NO: 4646 - protein, 271 aa, Secale cereale
MAYGGGGIAISWPLAARLARVLDSCIIRYPHLYGSDSRIYACLAELGVELTHEPGFHQIDLHGDISGFLRAHPLAPLVSLHHLDHVYPLYPGMDRAKSIAHLFRAANADPARILQQTVCYDHSRSLTASVAWGYSVQVFKGNVLLPDILAVQKTFVPWRRGRNVTDVFMFSTKHYPRDECKRAALFFLKSISSSKGKTESNYSRQLPRKCLPNLIPLRNMQQVKVRSELLHLVPGKALRRHCCDIVPSSSETTMDIDIRKCKDDELIAMHS

SEQ ID NO: 4647 - protein, 493 aa, Triticum aestivum
MATPSHSHGLPLAPLRTLLLALPLLSLILLLTLHLPPRHHPAPPGPLILPTPLRTTAAAAQPKPKADPSSSSSPSPTTLSHVVFGVASSRRTLPLRLPLLRLWLHLPARAFLFLDAPPRAASVPANLHLRVSRDASRFPYSYRKGLPSAVRVARIAKELLLELRQQQQHQSPPPRWLVLADDDTAFVLPNLLHTLSKYDWHEPWYLGAPSESAAQNVWHGFNMAYGGGGIAISWPLAARLARVLDSCIIRYPHLYGSDSRIYACLAELGVELTHEPGFHQIDLHGDISGFLRAHPLAPLVSLHHLDHVYPLYPGMDRAKAVEHLFRAANADPARILQQTVCYDHSRSLTASVAWGYSVQVFKGNVLLPDILAVQKTFVPWRRGRNVTDVFMFSTKHYPRDECKRAALFFLKSISSGKGKTESNYSRQLPQKCLPNLIQLRNMQQIKVRSELLHLVPGKALRRHCCDIVPSSSETTMDIDIRKCKDGELIAMHS

SEQ ID NO: 4648 - protein, 314 aa, Panicum virgatum
MAFSSLAPFSPPSGTFRHHPAGRPGAAASGSVVACSPPPPDVVVTRERGKNAELIAALEKHNIHSLELPLVKHVEGPDADRLSDVLRDDKFDWIIITSPEAAAVFLQGWKAAGSPKVQVAVVGAGTARVFDEVLQSEDRSLDVAFSPSKAMGKVLASELPKSSRNTCKVLYPASAKAGHEIQDGLSERGFDVTRLNTYTTVPVDVEPLTLNLAISAPVVAVASPSALRAWLNLIPKVDNWNNSIACIGETTGSAAKKLGLKSIYCPTTPGLEGWVESILEALRVHRQLKEAPKMLNTGSPVHRMTELLDVGDRL

SEQ ID NO: 4649 - protein, 304 aa, Setaria italica
MAFSSSLAFPFPSPPSGQARPAGRLRAGATGRFLGCSSPPPDVVVTRERGKNAKLIAALEKHNIQALELPLIKHVDGPDTYRLPDVLRNDKFDWITISSPEAAAVFLQGWKAAGSPKVRVAVVGAGTAKVFDEVSQSDDQSLEVAFSPSKAMGKVLASELPRGSESTCKVLYPASAKASHEIQDGLSDRGFHVTRLNTYTTVPVEDVEPLTLKLAISAPVVAVASPSALKAWLKLISKVDNWNNSIACIGETTGSAAKKLGLKSIYYPTTPGLEGWVESILEALRSHRQLKEVSYLILASYPDF

SEQ ID NO: 4650 - protein, 154 aa, Panicum virgatum
MAFSSLAPFSPPSGTFRPHPARRLRAAASGTGSVVACSPAPPDVVVTRERGKNAELIAALEKRNINSLELPLVKHVEGPDADRLSDVLRDDKFDWIVITSPEAAAVFLQGWKAAGSPKVQVAVVGAGTARVFDEVSQSEVRSLEVAFSPSKAMV

SEQ ID NO: 4651 - protein, 146 aa, Panicum virgatum
FSPPSGTFRPHPARRLRAAASGTGSVVACSPAPPDVVVTRERGKNAELIAALEKRNINSLELPLVKHVEGPDADRLSDVLRDDKFDWIVITSPEAAAVFLQGWKAAGSPKVQVAVVGAGTARVFDEVSQSEVRSLEVAFSPSKAMV

SEQ ID NO: 4652 - protein, 148 aa, Panicum virgatum
MGEVLASELPRGSESTCKVLYPASAKASREIQEGLSDRGFHVTRLNTYTTVPVEDVEPLTLKLAISAPVVAVASPSTLKAWLKLISKVDCWNNSIACIGETTGTAAKKLGLKSVYYPTTPGLEGWVESVLEALRVHRQLKEAPNVEHG

SEQ ID NO: 4653 - protein, 53 aa, Panicum virgatum
  misc_feature (3)..(3): Xaa can be any naturally occurring amino acid
  misc_feature (11)..(12): Xaa can be any naturally occurring amino acid
  misc_feature (32)..(32): Xaa can be any naturally occurring amino acid
MGXVLASELPXXSESTCKVLYPASAKASREIXEGLSDRGISCDKTEYIYTRTC

SEQ ID NO: 4654 - protein, 233 aa, Panicum virgatum
MAFSSSLAFPFPSPPSGTFQTRSAGRLRTGATERFLERSSPPPDVVVTRERGKNAKLIAALEKHNIQSLELPLIKHVDGPDTDRLPEVLSNDKFDWIAITSPEAAAVFLRGWKAAGSPKVRVAVVGAGTARVFDEVSQSDDQSLEVAFSPSKAMGKVLASELPRVSESTCKVLYPASAKASREIRESVFCLQLESSCYFLLLSLRPHVSHIYCVGFFMMLHIDFDPVNFLFSS

SEQ ID NO: 4655 - protein, 212 aa, Pennisetum glaucum
LPDVLRNDKFDWITITSPEAAAVFLQGWKAAGSPKVRVAVVGEGTARVFDEVSQTDAQSLEVAFSPSKAMGKVLASELPRGSESTCKVLYPASAKASCEIQEGLSDRGFHVTRLNTYTTVPVEDVEPLTLKLAISAPVVAVASPSAFKAWLKLISKVDNWNNSIACIGETTGSAAMKLGLKNIYYPTTPGLEGWVESILEALRVHRQLKEVG

SEQ ID NO: 4656 - protein, 505 aa, Setaria italica
MIRLQTYAAFSLLATASAVYYAFSSRDQFYPAMVYLSTSKICFVLLLNTGLVAMCVAWQLVKRIFLGSLREAEVERLNEQSWREVVEILFAVTIFRQDFSVSFLAMVAALLLVKALHWLAGKRVEYIETTPSVPTLSHIRIVSFMAFLLIVDCLFLSNSLRSLIQKREASVAIFFSFEYMILATSTVSTFVKYVFYVSDMLMEGQWEKKAVYTFYLELISDLVHLSLYMLFFIAIFLNYGVPLHLIRELYETFRNFKIRIADYVRYRKITSNMNERFPDATTEELNASDATCIICREEMTTAKKLLCGHLFHVHCLRSWLERQHTCPTCRAPIIPPDNGRAAAARQHGAQPGVQPAAGTGTPASEGASGENMSRRQAKLEAAAAAASLYGRSFAYPPANNLNRSGPPQSTSSTPQAEASSSNQSQKDQELQFQNTSNGLAPLPFNAHGAIGSGASTRDLENSLQKAQENFIKSQIEMLQIQLQMVQRGAAALANNNENAEHTKND

SEQ ID NO: 4657 - protein, 506 aa, Pennisetum glaucum
MIRLQTYAAFSLLATASAVYYAFSSRDQFYPAMVYLSTSKICFVLLLNTGLVAMCVAWQLVKRIFLGSLREAEVERLNEQSWREVVEILFAVTIFRQDFSVSFLAMVAALLLVKALHWLAGKRVEYIETTPSVPMLSHIRIVSFMAFLLIVDCLFLSNSLRSLIQKREASVAIFFSFEYMILATSTVSTFVKYVFYVSDMLMEGQWEKKAVYTFYLELISDLVHLSLYMLFFIAIFLNYGVPLHLIRELYETFRNFKIRIADYVRYRKITSNMNERFPDATTEELNASDATCIICREEMTTAKKLLCGHLFHVHCLRSWLERQHTCPTCRAPIIPPDNGRATAARQHGAQPGVQPAAGTGIPGSEGASDGENMSRRQAKLEAAAAAASLYGRSFAYPPVNNLNRSAPPQSTSSTPQAEASCSNQSQKDQELQFQHTSNGLAPLPFIAHGAIGSGTSTRDLENSLQKAQENFIKSQIEMLQIQLQMVQRGAAVLATNNENAEHTKND

SEQ ID NO: 4658 - protein, 505 aa, Sorghum bicolor
MIRLPTYAAFSLLATASAAYYAFSSREQFYPAMVYLSTSKICFVLLLNTGLVAMCVAWQLARRLFLGPLREAEVERLNEQSWREVIEILFAVTIFRQDFSVSFLAMVAALLLVKALHWLAQKRVEYIETTPSVPLLSHVRIVSFMVFLLTVDCLFLSNSLRSLIQKREASVAIFFSFEYMILATSTVSTFVKYIFYVSDMLMEGQWERKAVYTFYLELISDLVHLSLYMLFFIAIFLNYGVPLHLIRELYETFRNFRIRIADYVRYRKITSNMNERFPDATAEELDASDATCIICREEMTTAKKLLCGHLFHVHCLRSWLERQHTCPTCRAPIIPADNGRAASARQHGAQAGVQPAAGTATPSSEGAPGENISRRQAKLEAAAAAASLYGRSFVYPPANTLNRSGPPQSTSSTPQSEASSSNQSQKDQEMQLQNSSDGLVPLHVNANGAVGSGTSTRDLENSLQKAQENFIKSQIEMLQIQLQMVQRGAAASASNNGNAEHRKND

SEQ ID NO: 4659 - protein, 504 aa, Setaria italica
MIRLQTYTAFSLLAMASAVYYAFSSQEQFYPAMVYLSTSKICFVLLLNTGLVAMCVAWQLVKRLFLGSLREAEVERLNEQSWREVVEILFAITIFRQDFSVSLLAMVAALLLVKALHWLAQKRVEYIETTPSVPMLSHIRIVSFMAFLLIVDCLFLSNSLRPLIEKREASVAIFSFEYMILATSTVSTFVKYIFYVTDMLMEGQWERKAVYTFYLELISDLVHLSLYMLFFVAIFLNYGVPLHLIRELYETFRNFRIRIADYLRYRKITSNMNERFPDSTAEELNANDATCIICREEMTTAKKLLCGHLFHVHCLRSWLERQHTCPTCRAPIIPPDNGRAASSRQYGAQPGVQPAAGTGTPASEGAASENMSRRQAKLEAAAAAASLYGRSFAYPPANTLNRSVPPQSASSIPQSEASCSNQSQKDQELQFQNTNDGLAPQAFNAHGAISSGTSTRDLESSLQKAQENFIKSQIEMLQIQLQMVQRGAAVSATNNENAEHRKNG

SEQ ID NO: 4660 - protein, 501 aa, Panicum virgatum
MIRLQTYAAFSLLATASAVYYAFSSREQFYPAMVYLSTSKICFVLLLNTGLVAMCVAWQLVKRLFLGSLREAEVERLNEQCWREVVEILFAVTIFRQDFSVSFLAMVAALLLVKALHWLAQKRVEYIETTPSVPMLSHIRIVSFLAFLLIVDCLFLSNSFRSLMDKWEASVAIFFSFEYMILATSTVSTFVKYIFYVSDMLMEGQWEKKAVYTFYLELISDLVHLSLYMLFFIAIVLNYGVPLHLIRELYETFRNFRIRIADYVRYRRITSNMNERFPDATAEELNASDATCIICREEMTAAKKLLCGHLFHVYCLRSWLERQHTCPTCRAPIIPPDNGRAASARYGAQPGAAGIGTPASEGAAGENMSRRQAKIEVAIAAASLYGRSFAYPPANTLNRSGPPQSTSSIPQTEASSSNQSHKDQELQCQNTSDGLAPLPFNAHGGISSGTSTRDLEISLQKAQENFIKSQIEMLQIQLQMVQRAAAVSVTDNESAEHTKND

SEQ ID NO: 4661 - protein, 504 aa, Zea mays
MIRLPTYAAFSLLATASAAYYAFSSREQFYPAMVYLSTSKICFVLLLNTGLVAMCVAWQLARRLFLGSLREAEVERLNEQSWREVIEILFAVTIFRQDFSVSFLAMVAALLLVKALHWLAQKRVEYIETTPSVPLLSHIRIVSFMVFLLTVDCLFLSNSLRSLIQKQEASVAIFFSFEYMILATSTVSTFVKYIFYVSDMLMEGQWEKKAVYTFYLELISDLVHLSLYMLFFIAIFLNYGVPLHLIRELYETFRNFRIRIADYVRYRKITSNMNERFPDATSEELDVSDATCIICREEMTTAKKLLCGHLFHVHCLRSWLERQHTCPTCRAPIIPADNGHAVSARQHGAQAGVQPAAGTATPSSEGAPGENMSRHQAKLEAAAAAASLYGRSFVYPPANTLKRSVPPQPASSTPQSEASSSNHQSQKDQEMQSRNSSDGLVPLPLNADGAVGSGTSTRDLENSLQKAQENFIKSQIEMLQIQLQMVQRGAAGPPSNENTEHTEE

SEQ ID NO: 4662 - protein, 500 aa, Oryza sativa
MIRLQTYAAFSLMATATAVYYAFSSREQFYPAMVYLSTSKICFVLLLNTGLVAMCVAWQLVKRLFLGTLREAEVERLNEQAWREVVEILFAVTIFRQDFSVSFLAMVAALLLVKALHWLAQKRVEYIETTPSVPMLSHARIVSFMLFLLVVDCLFLSNSLRSLIHKREASVAIFFSFEYMILATSTVSTFVKYIFYVSDMLMEGQWEKKAVYTFYLELISDLVHLSLYMLFFIAIFLNYGVPLHLIRELYETFRNFRIRIADYVRYRKITSNMNERFPDATADELNASDATCIICREEMTTAKKLLCGHLFHVHCLRSWLERQHTCPTCRAPILPPDNGRTAARPHGVHPGVQPVPGNGTPGSERAAGENISRRQAKLEAAASAASLYGRSFAYPPANNLNRYSTPPQSTSNGPQSGEASTSNQSPKGHATADPSAPTFYARGAVSSVTTTRELESSLQKAYENAIKSQIEMLQIQLQMFQHGATSSATNNENGEHTKSD

SEQ ID NO: 4663 - protein, 494 aa, Brachypodium distachyon
MIRLQTYTAFSLLATMSAVYYAFSSREQFYPAMVYLSTSKICFVLLLNTGLVAMCVAWQLVKRLFLGTLREAEVERLNEQSWREVVEILFAVTIFRQDFSVAFLAMVAALLLVKALHWLAQKRVEYIETTPSVPMLSHIRIVSFMAFLLVVDCLFLSKSLGSLIQKREASVAIFFSFEYMILATSTVSTFVKYVFYVSDMLMEGQWEKKAVYTFYLELISDLVHLSLYMLFFIAIFLNYGVPLHLIRELYETFRNFRIRISDYVRYRKITSNMNERFPDATTEELNASDATCIICREEMTTAKKLLCGHLFHVHCLRSWLERQHTCPTCRAPIIPPDNGRAASARQHGAQPGAQPAAGTGNPSSGEAPSENVNMHQAKLEAAASAASLYGRSLAYPPASTLNRYSSPLHATSSTSQSGEASSSTGNPLAPRPFYSHGPVGSIASSRDPQISLQKAYENAIRSQIEMLHIQLQMVQQAATPSATNNGSSKHPENE

SEQ ID NO: 4664 - protein, 509 aa, Brachypodium distachyon
MIRLQTYAAFSLLATTTAVYYAFSSRVQFYPAVVYLSSSKICFVLLLNTGLVAMCVAWQLVKRVFLGKLREAEVERLNEQSWREVVEILFAVTIFRQDFSVAFLAMVAALLLVKALHWLAQKRVEYIETTPSVPMLSHLRIVSFMVFLLAVDCIFLSNSLMSLIKNWEASVAIFFSFEYMILATSTVSTFMKYVFYVSDMLMEGQWEKKAVYTFYLELISDLVHLSLYMLFFIAIFLNYGVPLHLIRELYETFRNFRIRVSDYVRYRKITSNMNERFPDATADELNLSDATCIICREEMTTAKKLLCGHLFHVHCLRSWLERQHTCPTCRAPIIPPDNGRAASARQHGAQRGVQLAAGAGTPGSGGAPSENVNMRQAKLEAAASAASLYGRSFAYPTNTLNRYSGPRHATSNASQSGEASTSNQSQTDQSVQWKHTGDALEPEPFISYGPVVPITSNGDLENSLQKAYENAIRSQIEILQIQLQMVQQGATTLATDNNNADRAPDPKNE

SEQ ID NO: 4665 - protein, 494 aa, Hordeum vulgare
MIRLQTYAAFSLLATVTSVYYAFSSREQFYPAMVYLSTSKICFVLLLNTGLVAMCLAWQLVKRVFLGTLREAEVERLNEQSWREVVEILFAVTIFRQDFSVSFLAMVAALLLVKALHWLAQKRVEYIETTPSVPMLSHIRIVSFMLFLLVVDCLFLSNSLGSLIQKREASVAIFFSFEYMILATSTVSTFVKYVFYVSDMLMEGQWEKKAVYTFYLELISDLVHLSLYMLFFIAIFLNYGVPLHLIRELYETFRNFRIRISDYVRYRKITSNMNERFPDATPDELDTSDVTCIICREEMTTAKKLLCGHLFHVHCLRSWLERQHTCPTCRAPIIPPDNGRAASARQHGAQPGVQPGAGAGTPNSGGAPTENVNMRQAKLEAAASAASLYGRSFAYPPVNTLNRHSGPLHATPSTSQSGEASTSTGHPLEPQPSYSTGPVSSITSSRDPENSLQKAYEKAIRSQIEVLQIQLQMMQQGATTTSATGNESAEQAEK

SEQ ID NO: 4666 - protein, 347 aa, Saccharum officinarum
MHYVCYNAGKSKLASGDYDESVKPSQINGSTLKHQSDMPPPPAPPPRNNNFNGKEKQPVPIARADDDDIFVGDGVDYSVPNKEMSQSPVAEDMEESPHNNHQKQSYFTEPMYGPVPPSESAQAWQQPNEYDAAQAQMVAAGYQGDWSGYVYPEQPLGYQEQYVQQSTQEYDVLADPSISQDPRFMTQADKDRGLGSVFKRDDQRLNQLREKDARERDPNFISDSYSECYPGYQEYNNEIAGSDDEDDLSKMDMGGRAKGRLHRWDFETEEEWAKYNDQKETMPKAAFQFGVKMQDGRKTRKQNKDQKLTNDLHKKNKILARKKGEKDGADDGGHYDDDLPSAKKQRG

SEQ ID NO: 4667 - protein, 344 aa, Zea mays
YVCYNAGKSNLASGDYGESVKPSQTNGSTLKHQSDMPPPPAPPPRNNNFNGKEKQPVPVSREDDDDIFVGDGVDYLVPNKEMSQSPVSDMDESPHNHQKQSNFTEPLYGPVPPSESAQAWQQPNTYDAAVQAQMAAAGYQGDWSSYVYAEQQLGYPEQYVQQSTQEYDVLADPSISQDPRFMTQADKDRGLGSVFKRDDQRLNQLREKDARERDPNFISDSYSECYPGYQEYNNEIAGSDDEDDLSKMDMGGRAKGRLHRWDFETEEEWAKYNDQKEAMPKAAFQFGVKMQDGRKTRKQNKDQKLTNDLHKINKILARKKGEKDGAEDGGHYDDDLPSSKKQRG

SEQ ID NO: 4668 - protein, 450 aa, Hordeum vulgare
RETKEDRAVSFRTAIAKSVYQWTVKQQQSMIKANDMFLPGRMAFIYNMEDGLNSDIPTTLHRSKADCPVPEEMVTVSVDGSVLDRIAKIMSYLRLGSSGKVLKKKKKERDTKGKNNLAGGVYNETVRPAQSDGSVQKYHSEKDMLPPPPPPPRKSNFSEKEKHSVPVARADDDDIFIGDGVDYAVPNKEMSQSPISEDMDESPRIHQNQSNLNEPVYGPIQPSEPAQAWQQPMDGYDAIQAQMAAAGYQGEWSGYQYAEQQLAYPEQYMQQGTLGYDVLVDPNISQDPKLMTQADKDKGLGSVFKRDDDRLKQLREKDAREKDPNFISDSYSECYPGYQGYNQEIAGSDDEDDLSKMDMGGRAKGRLHRWDFETEEEWAKYNDQKEAMPKAAFQFGVKMQDGRKTRKQNKDQKLSNDLNKINKILARKKGDKDGEGHYDDDLPSGKKQRA

SEQ ID NO: 4669 - protein, 555 aa, Sorghum bicolor
MPGCTTPSPASTTTTEADNAEDLSEAVADDAVLAYINQFLLEDEDEESYPVTSVPVEDSVLLAAVEKPFVDILKSANHITAKAYEVKSWITDDCHSTGSGRFHDVVTSTLDSTQLAPEMVQGDVVDAVHKGQKNPRDNDLEVERRKSKQSALCDEETVREMFDKVLLCTDKNCAFHSPMPADAQNSGGYVKGSGNRRGRRKGRSGAGAEQEPVDLTTLLIHCAQAAAIDDHRNSSEHLKQIRKHSSATGDAGQRLAHYFADGLEARLAGTGSSIYRSLAAKRTSTGDMLKAFNLYVKACPFRIISHYVANTTILNATKSVTRLHIIDYGIMYGFQWPILMQRLSKRSGGPPTLRITGIDFPLSGFRPAERVEATGRRLHEYARMFNVPFEYQAIAAKWDTIQVKDLNIKSDEFIVVNCLYRMRNMMDETATDDSPRTRVLNTIRKLNPHLFVHGIVNGTYNAPFFVTRFKEAMFFFSSIFDMLEANASRMDEHRLLIEREFFGREAINVIACEGTERIERPETYKQWQMRNLRAGFRQLQGWKGRVIYALSAWST

SEQ ID NO: 4670 - protein, 582 aa, Zea mays
MPGCTTPSPASTTTTEPDSVEDFSETVADDAVLAYINQFLLEDEDEESYPITSAPVEDSALLAAVEKPFVDILESAKPIAAQGYEVKSWITDDCDSTGSGRFRDVVTSSLPREMVREGLVGAAHKGQKNPRDEDMEMEGRKSKQSALCDEETVREMFDKVLLCTDKNCEFHSPMPADAQISGGYVKGSRNKRGRRKGRSGSGAEEEPVDLTTLLIHCAQAAAIDDHRNSSELLKQIRKHSSATGDAGQRLAHYFADGLEARLAGSGSSIYRSLAAKRTSTGDILKAFSLYVKACPFRILSHYVANTTILNATKSATRLHIIDYGIMYGFQWPVLMQRLSKRPGGPPYLRITGIDFPLSGFRPAERVEATGRRLHEYARMFNVPFEYQAIAAKWDTIQVKDLNMKSDEFVVVNCLYRMRNMMDETVTDDSPRTRVLNTIRKLNPHLFVHGIVNGTYNAPFFVTRFKEAMFFFSSIFDMLEANALRMDEHRLLIEREFFGREAVNVIACEGTERIERPETYKQWQMRNLRAGFRQLALDREIMKRARYKVSKSYQGDFLVDEDNKWMLQGWKGRIIYALSAWTS

SEQ ID NO: 4671 - protein, 583 aa, Setaria italica
MLGCTTPSPASTTTTELDSADDADDAVLAYINQFLLEDEDDESYPVSSASVEDSALLAVEKPFVDILKSAKPIMAQAYEMKSWMTDDCESTGSRGFHDVVTSNQNSSQLPSQMVVECSVGATHKGRKTKNPHDDDLEMEERKSKQLALCDEETVREMFDKVLLCTDANCEFHSPMPAEAQINGRYVKGSGNRRGRRKGRSGTSPEEEAVDLTTLLIHCAQAAAIDDHRNANELLKQIRKHSSATGDAGQRLAHYFANGLEARLAGTGSSIYRSLTSKRTSTGEMLRAFGLYVKACSFRLISHYVANTTILNASKSEARLHIIDYGVQYGFQWPVLMQRLSKRCGGPPSLRITGIDFPLPGFRPAERIEATGRRLHEYARMFNIPFEYQAIASKWDTIQVEDLKIKSDEYLVVNCLYRMRNMMDETVTDDSPRTRVLNTIRKLNPHLFVHGIVNGTYNAPFFVTRFKEAMFFFSSIFDMLEANASRMDEHRLLIESEFFGREALNVIACEGTERIERPETYKQWQMRNLRAGFRQLRLNEEIMKRARYKVSKSYHRDFLVDEDNKWMLQGWKGRIIFALSAWTS

SEQ ID NO: 4672 - protein, 625 aa, Pennisetum glaucum
MMDPASRDNIDLGDQLSAPNPPTLINFSLQRQSQVQYFPQYGFHSHNPPSHPSPPWVMLGCSTPSPASTTTTEVDSAEELSETAADDAVLAYINQFLLEDEDDESYPVSSASVEDSALLAVEKPFVDILKSAKPITAQAYEVKSWMTDDCESTGSGGFRDVVISNQNSSQLLSQMVVECSVGAAHKGRKNPPDDGLEMEERKSKQSALCDEETVREMFDKVLLCTDANCEFSSPVPAEAQINGRYVKGSGNKRGRRKGRSGTNPEEEAVDLTTLLMHCAQAAAIDDHRNANELLKQIRKHSSSTGDAGQRLAHYFANGLEARLAGTGSSIYRSLTSKRTSAGEMLRAFGLYVKACSFRLISHYVANATILNASNSSARLHIIDYGILYGFQWPVLMQYLSKRCGGPPSLRITGIDFPLPGFRPAERVEATGRRLHEYARMFNIPFEYQAIAAKWDTIQVEDLKIKSDEYLVINCLHRMRNMMDETVTDDSPRTRVLNTIRKLNPHLFVHGIVNGTYNAPFFVTRFKEAMFFFSSIFDMLEANASRMDEHRLLIESEFFGREALNVIACEGTERIERPETYKQWQMRHLRAGFRQLRLNEEIMKRARYKVSKRYHRDFLVDEDNKW

SEQ ID NO: 4673 - protein, 672 aa, Setaria italica
MEVAALEKKGHRAFAKPLKSFSSSEHKRSKRLVSAAFCNFFFFSCDSAGKDAQIVIKRFLNGSYFEDMYAADALRSSDKTIVLPKPEVVKAKVKSDINKDVQPGRGAQSTLRKEILQLEKHLKDQQVVRGALEKALGPDAAPVNLSPENPMPKAANELIREIATLELEVKNMEQYLLTLYRKAFEQQAPTFSPPDHQDASKPSVSSRSGQLREMPMAMKSCKSRGDAALRSSYPPPHKKWNDPLTDCCTSVRPDRAVDSDVLRCQSALSYRGVCSSRILPSEDDSLARALRSCHSQPFSFLEEGETGASGMISLAEYLGTNVADHIPETPNNLSEEMVRCMAGIYCRLADPPLVHHGSSSSPTSSFSSASAISPQYVGDMWSPNYKRENTLDSRLINPFHVEGLKEFSGPYNTMVEVPMISRDSRRLKEAEDLLQTYKLILYRLETVDLRRMTNEEKIAFWVNIHNALLMHAYLKNGVPQNNLKKTSLLAKAACKIAGRNINVAVIQSMVLGCNTHCPGQWLRTLLYPRIKSKVSKAGHEWRAFAVAQSEPLLRFALCSGSHSDPAVRVYTPKRLFHQLEAAKEEFIRATAGVWREQKLLLPKLVEAYAKDVKLSPQGLVDMVQRYLPESMRMAVQRCQQGGRSSSKVVEWVPYNPAFRYLLARDLAFPHLS

SEQ ID NO: 4674 - protein, 167 aa, Panicum virgatum
MGHLHLAKPPKSCKKKKTGPVSGGREISLLPRERHRRLAKPTTVVGFIGISLRSCRAPPPQSRTPHPPPKWPPPPPPPPPRDPSSDPAPPSSLRSAAARAASRAGPAPLPRRMPTSAPRVLLRSPVEMSSVCLESLMPMHSATASALMTSLLAAPACKGFGWLLEDG

SEQ ID NO: 4675 - protein, 984 aa, Zea mays
VLPPLPEATHQFNSRESDWGFTSFMPLLDLYDSSKGYVVNDKCIIEAEVAVRKTLDFWNYDSKRMTGYVGLKNQGATCYMNSLLQTLYHIPYFRKAVYHMPTTENDTPSGNIPLALQSLFYKLQHSDNSVATKELTKSFGWDSYDSFMQHDVQELNRVLCEKLENKMKGTTVEGAIQKLFEGHHMNYIECINVESKSTRKESFYDLALDVKGCSDVYASFDKYVAVERLEGDNKYQSEEHGLQDAKKGMLFIDFPPVLQLQLKRFEYDFVRDTMLKINDRYEFPLQLDLDRDDGKYLSPDADRSVRNLYTLHSVLVHSGGVHGGHYYAFIRPKLSDQWYKFEDERVTKEDMKRALEEQYGGEEELPHTNPGLDTAPLRFTKHSNAYMLVYIRESDKDNIICDLDDEDISEHLKVRLRKEHEEKEYKKKEKAEAHMFTALKVARDFDIKEQIGRHMHFDLVDFDRVNSFRAPKNMSINEVKEELSKEFGIPVECQRFWVWAKRQNCTYRPSRPLTSQEETSTIGVLKDATVAKLPNSEVRLFLEVHFRQENQPIAPWNTKEDILLFFKLYDPEKEDLRYVGNFFVKASGKPSDIVERLNQIAGFLSDEDIELYEEIKFEPVVMCVPIESNASFRSSQIDNGDIICYQKHCLPDSMDRYRYPTVPSFFEYIHNRQIVHFRLLEKPKEEGFSLELSKCSTYDDVVEKVAKQLRMDDPSKIRLTQHNPSSQQPKPHFIKYRSLNYLSDMLHNHNQMCDILYYDILDIPLPELESMRSLKVAFQNAANHEMSFHIMRLPKSNSLLDLIEDLKSKVEISCNDAEFRFFGVYLHKICKVYQPGDKIDSVNDHGPLYIEEVPEDEKNAGPHDRLVHVYHFEYNHHIQYFGEPFFFLIRDGEALSDMKVRIQKRLQVPDEQFLKWKFAHVTFSKPEYLQDSDIVMNRFHKQRPVYGGWEQHLGLEHTATTPKRSYLGNNQNRHSFEKPVRIYN

SEQ ID NO: 4676 - protein, 461 aa, Setaria italica
MNQAALGRSCTGTFCGDLLVGAMAHSWRMLVQGLTSLMFFCAHADEYVRPPPSPLVLMAHDKPASHPQQVHISVVGPNHMRISWVTDDRNAPSVVEYGTSPGKYTASATGNHTTYHYFFYKSGAIHHVTIGPLEPVTTYYYRCGRAGDEFSFRTPPATLPIEFVVIGDLGQTGWTASTLSHIGGGDYDMLLLPGDLSYADTQQPLWDSFGRLVQPLASARPWMVTEGNHEMETLPVVEFAPFAAYNARWRMPHEESGSRSNLYYSFDAAGGAAHVVMLGSYAAFGEGSEQHRWLEADLARVDRRRTPWLLVLLHAPWYNTNQAHQGEGERMRLAMERMLYEARVDVVFAGHVHAYERFTRIYDNEADSRGPMYITIGDGGNREGLALRFIEDHKSAHLSVFREASFGHGRLRIVNETSAVWTWHRNDDEYATVRDEVWLESLAAAKPSLATTTAGRHTDEL

SEQ ID NO: 4677 - protein, 460 aa, Panicum virgatum
MNQAALGRSFTGTFCGDLVAGAMAHSWRLLVQGLTSLMFLCARADEYVRPPPSPLVLMAHDKPASHPQQVHISVVGAKKMCISWVTDDRSAPSVVEYGRSPGKYTASAAGDHTTYHYFFYKSGAIHHATIGPLEPGTTYYYRCGKAGDELSLRTPPATLPIEFVVIGDLGQTGWTASTLSHIGGGDYDMLLLPGDLSYADTQQPLWDSFGRLVQPLASARPWMVTAGNHEMEALPVVELAPFAAYNARWRMPHEESGSRSNLYYSFDAAGGAAHVVMLGSYAAFGEGSEQRRWLEADLARVDRRRTPWLLVLLHAPWYNTNQAHQGEGEKMRLAMERMLYEARVDVVFAGHVHAYERFTRIYDNEADSRGPMYITIGDGGNREGLALRFIADHRSAHLSVFREASFGHGRLRIVNETSAVWTWHRNDDEYATVRDEVWIESLAAGKQSIARTAGRHTDEL

SEQ ID NO: 4678 - protein, 547 aa, Saccharum officinarum
DFPYDKLDISDEVREQVELVHVQLKRAKERVDMPDDEFYNELLSLYNKSHDPSAELDILGRLSKKLHLMTITDLTQESLALHEMVASGGGNDPGEHVEKMSMLLKKIKDFVQTQNPEMGPPVTTKLMDSNGQPRPVNIPDEFRCPISLELMKDPVIVATGQTYERTFIEKWLASGHHTCPNTQQRMPNTTLTPNYVLRSLIAQWCEANGIDPPKRSTQPDKPTSSCSPSERAIIDALLFKLCSADPEEQRSSAAELRLLAKRNANNRICIAEAGAIPLLLSLLSSSDLQTQEHAVTALLNLSIHEDNKSSIILSGAVPGIVHVLKNGSMQARENAAATLFSLSVVDEYKVTIGGTGAIPALVVLLSEGSPRGMKDAAAALFNLCIYQGNKGRAIRAGLVPLIMGLVTNPTGALLDEAMAILSILSSHPEGKAAIGAAEPVPVLVEMIGSGSPRNRENAAAVMLHLSVHNVHLARAQECGIMVPLRELALNGTERGKRKAVQLLERMSRFLVMQHEDIASQQLDEIERQLVALGPNVTEADLDQLGLL

SEQ ID NO: 4679 - protein, 610 aa, Zea mays
RGEHVKEFQGRCRSYFLVYMRYTRGLIPPVVLVLDRDEVMKKFHESIAQLEQALCDFPYDKLDISDEAREQVELVHAQLKRAKERVDMPDDEFYNELCSLYNKSHDPSAELDILGRLSEKLHLTTIADLTQESLALHEMVASGGGNDPGEHIEKMSMLLKKIKDFVQTQNPETGPLVTAKPMGSNGKPRPVNVPDEFRCPISLELMKDPVIVATGQTYERALIEKWLASGHHTCPSTQQRMPNTTLTPNYVLRSLITQWCEANGIDPPKRPTQQPDRPTSSCSSSERASIDALLSKLCSADPEEQRSAAAELRLLAKRNANNRICIAEAGAIPLLLSLLSSSDLQTQEHAVTALLNLSIHEDNKASIILSGAVPGIVHVLKNGSMEARENAAATLFSLSVVDEYKVTIGGTGAIPALVVLLSEGRQRGKKDAAAALFNLCIYQGNKGRAIRAGLVPLVMGLVTNPTGALLDEAMAILSILSSHPEGKAAIGAAEPVPVLVEMIAGGSPRNRENAAAVMLHLSASVRQSAHLARAQECGIMAPLRELALNGTGRGKRKAVQLLERMSRFLVQQQEDAVDPRVQELEEIERQLAAFGPGVTEADVLQQLGAL

SEQ ID NO: 4680 - protein, 586 aa, Panicum virgatum
MYALQVLERDNVLKKFQGVIAQLEQALCDFPYDKLDISDEVREQVELVHAQLRRAKERADMPDDEFYNDVLSLYNKSYDPSAELDILERLSEKLHLMTITDLTHESLALHEMVASGGGQDPGEHIEKMSMLLKKIKDFVQTQNPEMGPPIGTKLMDSNGEPRPVNIPDEFRCPISLELMKDPVIVATGQTYERACIEKWLASGHHTCPNTQQRMTNTTLTPNYVLRSLIAQWCEANGIEPPKRSSQPNKPTSACSSSERANIDALLSQLCSHDPEEQRSAAAELRLLAKRNANNRICIAEAGAIPLLLSLLSSSDLRTQEHAVTALLNLSIHEDNKASIISSGAVPSIVHVLKNGSMQARENAAATLFSLSVIDEYKVTIGGTGAIPALVVLLSEGSQRGKKDAAAALFNLCIYQGNKGRAIRAGLVPLIMGLVTNPTGALMDEAMAILSILSSHPEGKAAIGAAEPVPVLVEMIGSGSPRNRENAAAVMLHLCSGEQQLVHLARAQECRIMVPLRELALNGTERGKRKAVLLLERMSRFLVQQQEEKEAQLLASAQAIPRIAEQVQETDIPEQLDSPSPQYPMVA

SEQ ID NO: 4681 - protein, 626 aa, Pennisetum glaucum
REARAGWGGAPAEGDQERVLAPLADALETALDLLQLGRDGSRIFLVLERDNIMKKFQGVIAQLEQALCNFPYDKLDISDEVREQVELVHAQLRRAKERTDMPDDEFYNDVLSLYNKNYDPSAELDILERLSEKLHLMTITDLTQESLALHEMVASGGGQDPGEHIEKMSMLLKKIKDFVQTQNPEMGPPIGTKIMDSNGEPRPANIPDEFRCPISLELMKDPVIVSTGQTYERVCIEKWIASGHHTCPNTQQRMTNTTLTTNYVLRSLIAQWCEANGIEPPKRSPQPSKPTLACSSSERASIDALLAQLCSPDPEEQRSAAAELRLLAKRNANNRICIAEAGAIPLLLSLLSSPDLRTQEHAVTALLNLSIHEDNKASIISSGAVPSIVHVLKNGSMEARENAAATLFSLSVIDEYKVTIGGTGAIPALVVLLSEGSQRGKKDAAAALFNLCIYQGNKGRAIRAGLVPLIMGLVTNPTGALMDEAMAILSILSSHPEGKAAIGAAEPVPVLVEMIGSGSPRNRENAAAVMLHLSSGEQQLVHLARAQECGIMVPLRELALNGTDRGKRKAVHLLERMSRFLVQQQEEKEAQLLASTQAIPQIPEQVQEIDIPEQLDSPSPQYPMAA

SEQ ID NO: 4682 - protein, 693 aa, Oryza sativa
SISPLFTILPLAEVSSSSSSSRCFASRSPWPATERRRRRGRRRLRRRVPRRRWRGWRRIRLLGPFVEELRERRRGEGEGEEEERALAPLADALEAALALLRLGREGSRISLVLERDSVMKKFQGVILQLEQALCDIPYNELDISDEVREQVELVHAQLKRAKERIDMPDDEFYNDLLSVYDKNYDPSAELAILGRLSEKLHLMTITDLTQESLALHEMVASGGGQDPGEHIERMSMLLKKIKDFVQTQNPDMGPPMASRVLDSNGDSRPITIPDEFRCPISLELMKDPVIVSTGQTYERACIEKWIASGHHTCPTTQQKMSTSALTPNYVLRSLISQWCETNGMEPPKRSTQPNKPTPACSSSERANIDALLSKLCSPDTEEQRSAAAELRLLAKRNANNRICIAEAGAIPLLLSLLSSSDLRTQEHAVTALLNLSIHEDNKASIISSGAVPSIVHVLKNGSMEARENAAATLFSLSVIDEYKVTIGGMGAIPALVVLLGEGSQRGKKDAAAALFNLCIYQGNKGRAIRAGLVPLIMGLVTNPTGALMDEAMAILSILSSHPEGKAAIGAAEPVPVLVEMIGSGTPRNRENAAAVMLHLCSGEHHLVHLARAQECGIMVPLRELALNGTDRGKRKAVQLLERMSRFLVQQQEEQESQSQASAQVPPQATPEQVPENDIPEQLDSPASQYPMVV

SEQ ID NO: 4683 - protein, 695 aa, Brachypodium distachyon
MAGDREEDEEGEGVALAPRPATATERVAKAVDAATTCSTAGEYRNAYKRPLLALSRRIRLLGPFAEELRERRAPAEKEEDGEEKTLAPLADALEKALDLLRLGREGSRISLVFERDRVMKQFQEVIAQLEQALCDFPCNELDISDEVREQVELVHAQLKRAKERVDMPDDEFYNDLLSLYNKTYDPSAEQAILERLSEKLHLMTIIDLTQESLALHEMVASGGGQDPGEHIEKMSMLLKKIKDFVQTRNPEMGPPMVSTVMDSNGEQKSIAVPDEFRCPISLELMKDPVIVATGQTYERTCIEKWLASGHHTCPTTQQRMANTTLTPNYVLRSLISQWCETNGVEPPKRSSQPDKPTPVCSPSERANIDALLTKLCSPDLEEQRSAAAELRLLAKRNAHNRLCIAEAGAIPLLLSLLASSDLRTQEHAVTALLNLSIHEDNKASIMSSGAVPSVVHVLKNGSMEARENAAATLFSLSVVDAYKVIIGGTGAIPALVVLLSEGSQRGKKDAAAALFNLCIYQGNKGRAIRAGLVPLIMGLVTNPTGALMDEAMAILSILSSHQEGKAAIGAAEPVPALVDLIGSGSPRNRENAAAVMLHLCCGEQQLVHLARAHECGIMVPLRELALNGTDRGKRKAVQLLERMSRFLVQQQEEHESHSRLQAALVQVLPEAPVQVQEGEIPDQLDSPVPQYPVLL

SEQ ID NO: 4684 - protein, 436 aa, Solanum phureja
MKKLKPLLHLLLPLCVHWIAEEMTVSVLVDVTTGALCPGKTTCSEAIYINGVQQTVVGIFKMIVLPILGQLADEYGRKPLLILTVSTTIIPFGLLTINKSREMVYAYYILRTISYIISQGSIFCISVAYAADVVDVSSRAAVFSWITGLFSASHVLGNVLARFLPVGYIFQARWCLLIFVPVYMQVFLEETVAPKTEVSQSSTLKSNTLKIVKERYNSMRYAANLVTSSPTLKCISLVSFFYELGMSGISGVLLYYLKSAFGFNKNQFSEILMMVGVGSIVSQIVVLPLINPLFGEKVILCMALLSSIAYAMLYGLAWAPWVPYLSASFGVIYILVKPSTYAVISKAALSADQGKAQGFVAGIQSVASLLSPIVMSPLTSWFLSRDAPFNCKGFSILCASLCMVVSLCYASTLKVEAPRERTFDENAENIEAPLLT

SEQ ID NO: 4685 - protein, 279 aa, Triticum aestivum
MIMTKGHSRIPIYSGRPSNIIGLILVKNLLTCRPEDEVPTRHVTIRKIPRVADDLPLYDILNEFQKGHSHMAVVVKRTKEEGASVEKNNSFTADYKMTNGHAHADGLGLSPSHVNIPGSRRNNNDKYSKKIERKRDNILDFNTDPLPHYSMDEEAVGIITMEDVMEQLLQEDILDETDEYVDVHNKIKINMLPPGKSVSPLISPSGEPLSQGLRKTPMASPLSPYHNGGSILRSPVANHARSPGTLPTMFSPGRSPASQTPVRSSPTSSWVSRNSYRNP

SEQ ID NO: 4686 - protein, 621 aa, Triticum aestivum
MEEPHWERERLLDLAVDYGFDRDFAVAALSRLVHLYGEGGQDFITVENCGDDFIAALADATQLTDDWDDLNAIETEACGNLNEMMRKGVNDEKGGVVLDTPLFKRADSSSQHNPKGLKTSSFSSDDSDFDIFDETNTHRDNNVGTQKKPQTRNSKAQTRSSTKSTVTKGTKRYESTTPTSNREGQPNACLRKREILSYEQLSSLDDINLANAVIFGNKSFRPLQYEACSAALDNKDCFILMPTGGGKSLCYQLPATLHPGVTVVVCPLLSLIQDQVVALTFKFGIQAAFLNSQQTAAQASAVIQELRNGTPSFKLLYVTPERMAGNYPFMEILKGLHQRGLLARFVIDEAHCVSQWGHDFRPDYRGLGCLKQHFPRVPIMALTATATEAVRKDVLSTLRIPNALVLKRSFDRHNLKYMVIGKTRTPQMQLGELLKERFMNMSGIVYCLSKNECADTAKFLREKYKIKCAHYHAGLAARQRSSVQEKWHRGEVKVICATIAFGMGIDKPDVSFVVHNTLSKSIESYYQESGRAGRDGLPAHCVVLYQKKDFSRIVCMLRSADNFKSETFKVAMDQAKKMQAYCELKTECRRQTLLGHFGEQFNSQRCKDGPSPCDICLKEAS

SEQ ID NO: 4687 - protein, 633 aa, Secale cereale
FDPCRRLREPEMEEPHRERERLLDLAVDYGFDRDFAVAALSRLVNLYGEGGQNFITVENCGDDFIAALADATQLTDDWDDLNAIETEACGNLNEMMRKGVINDEKGGVVLDTPLFKRADSSSQNSPKGVKTSSFSSDDSDFDIFDETNTHRDNSVGTQKKARTRNSKAQTRSSTKSTVTKGTKRYESTIPTSNREGQPNSCLRNREILSYEQLSSLDDINFANAVIFGNKSLRPLQYEACSAALDNKDCFILMPTGGGKSLCYQLPATLHPGVTVVVCPLLSLIQDQVVALTFKFGIQAAFLNSQQTSAQASAVIQELRNGTPSFKLLYVTPERMAGNYSFMEILKGLHQRGLLARFVIDEAHCVSQWGHDFRPDYRGLGCLKQHFPRVPIMALTATATEAVRKDVLSTLRIPNALVLKRSFDRHNLNYMVIGKTRTPQMQLGELLKERFMNMSGIVYCLSKNECADTAKFLREKYKIKCAHYHAGLAARQRSSYQEKWHRGEVKVICATIAFGMGIDKPDVRFVVHNTLSKSIESYYQESGRAGRDDLPAHCVVLYQKKDFSRIVCMLRSADNFKSETFKVAMDQAKKMQAYCELKTECRRRTLLGHFGEQFNSQRCKDGPSPCDICLKEAS

SEQ ID NO: 4688 - protein, 626 aa, Brachypodium distachyon
VRGRALLDGEMAGIERERLLELAAGYGFDRGLAADCIATLLNLYGADGQGFITVENCGDDFLGALADATQDTDDWDDLNAIETEACGNLNKMMGKGVPHEKGGVAANTPLSERANTSSQHTPDNPKTLSFSSDDDSDFEMTTHRDSSFGTQKKAQPRNSKVQTRSSAKSTVTKGSNRYGSPTPTSSKERRPNTFHQKRETLSYEQLSCLDDLNLANAVIFGNKSFRPLQYEACSAALNNRDCFILMPTGGGKSLCYQLPATLHPGVTVVVCPLLSLIQDQVVALTFKFGIQASFLNSQQTSSQASVVMQELRNGTPSFKLLYVTPERMVGNYSFMEILRGLHQRGLLARFVIDEAHCVSQWGHDFRPDYRALGCLKQNFPRVPIMALTATATEAVRKDILSTLRVPNALVLKRSFDRLNLNYMVIGKTKTPQMQLGELLKERFMNMSGIVYCLSKNECADTAKFLREKYKIKCAHYHAGLAARQRTSVQEKWHRGEVKVICATIAFGMGIDKPDVRFVIHNTLSKSIESYYQESGRAGRDDLPAHCVVLYQKKDFSRIVCMLRNGDNFKSETFKVAMDQAKKMQAYCELKTECRRQTLLAHFGEQYDRQRCKDGPSPCDNCLKTAS

SEQ ID NO: 4689 - protein, 608 aa, Secale cereale
MCSGPRKPSTPPPVAAAPKDSAAMASLLLELAAADNVVEFRRVVEEEKASLDAAGSWYGPSAVGLGRLAAESRTPAMVAALYGSTAVLAHALSVAPGEACRASDTDGATALHMAAAGGAANAVAATHLLLAAGASTEALSVSGLRAGDLLPRAAGVSEKPLRLLLKSPAVSPSSSPKKSASPPAMVAAQEPRKEYPPDLTLPDLKSGLFSTDEFRMYSFKVKPCSRAYSHDWTECPFVHPGENARRRDPRRYSYSCVPCPEFRKGGSCRKGDGCEYAHGVFECWLHPAQYRTRLCKDEVGCARRICFFAHRRDELRSVNPSAVSVGMMQPVSPRSSPPNGMDMGMLNPAGWPSSPVSRLKTARELDFDLEMLALDQYQQKLFDKVSNNAHSPRASWGAPNGGLGSPHAAGSPARNMPDYTDLLGSMDPAMLSQLHALSLKQAGDMSPYSSMPDTQLHMPTSPMVGANNSFGLDHSMAKAIMTSRASAFAKRSQSFIDRGARAPAARSLMSPATTIGEPSMLTDWGSPSGGGNLDWGSPGGKLDWGVQGDELHKFRKSASFGFRGQTAMPAAAAATPAEPDVSWVNSLVKDGHTGDHFPQWLEQEQMVA

SEQ ID NO: 4690 - protein, 609 aa, Triticum aestivum
MCSGPRKPSTPPPVAAAPKDPAAVASLLLELAAADDVVEFRRVVEEEKACLDAAGSWYGPSAVGQGRLAAESRTPAMVAALYGSTAVLAHALSVAPGEACRASGTDGATALHMAAAGGAANAVAATHLLLAAGASTEALSVSGLRAGDLLPRAAGVAEKPLRLLLKSPAVSPSSSPKKSASPPAAMVAAQEPRKEYPPDLTLPDLKSGLFSTDEFRMYSFKVKPCSRAYSHDWTECPFVHPGENARRRDPRRYSYSCVPCPEFRKGGSCRKGDGCEYAHGVFECWLHPAQYRTRLCKDEVGCARRICFFAHRRDELRSVNPSAVSVGMMQPVSPRSSPPNGMDMGMLNPAGWPSSPVSRLKTARELDFDLEMLALDQYQQKLFDKVSNSAHSPRASWGAPNGGLGSPHAAGSPARNMPDYTDLLGSMDPAMLSQLHALSLKQAGDMSPYSSMPDTQLHMPTSPMVGANNSFGLDHSMAKAIMTSRASAFAKRSQSFIDRGARAPAARSLMSPATTIGEPSMLTDWGSPSGGGNLDWGSPGGKLDWGVQGDELHKFRKSASFGFRGQSAMPAASAATPAEPDVSWVNSLVKDGHTGDHFPQWLEQEQMVA

SEQ ID NO: 4691 - protein, 845 aa, Brachypodium distachyon
MPGRRRKLQVAALLLLFCVCSSAGIICRAQLVDQFKPADSYLVNCGSAKGTTVSERNFAADGAAPLTVSTPQEILAGTSANGVSSFDNSALYQTARIFTGPSSYTFPINKQGRHFVRLYFFPFIYQSYDLSTAKFTVSTQDVLLLSDFQQPDKTAPLFKEYSLNITRDQLIISFKPSNGIAFVNAIEVVSVPDDLIADVAQMVNPVQQYSGLSTQSLETVYRVNMGGPKVTPNNDTLSRTWLNDQKFIMNPSVTKKVVYGKTIKYKNGGASSLTAPDVVYSTATELAASNTSNALFNMTWQFDVDAGFSYLIRFHFCDIVSKALNQLYFNAYVGGFFAQHDLDLSEQSMNQLATAIYVDVVLSSNDASSKLSISIGPSTLNNAFPDGILNGLEVMKMGSGSGSAFTVGSSGSKKILAVIIGSVIGVIGLLVIVLLLVLLCRRKKTDDKQHSKTWMPFSINGLTSLSTGSRTSYGTTLTSGLNGSLGYRFAFNVLQEATNNFDENWVIGVGGFGKVYKGVLRDDTKVAVKRGNPKSQQGLNEFRTEIELLSRLRHRHLVSLIGYCDERNEMILVYEYMENGTVKSHLYGSDNPSLNWKQRLEICIGAARGLHYLHTGSAKAIIHRDVKSANILLDENFLAKVADFGLSKTGPELDQTHVSTAVKGSFGYLDPEYFRRQQLTEKSDVYSFGVVMLEVLCARPVIDPTLPREMVNLAEWGMKWQKRGELHQIVDQRLSSTIRPDSLRKFGETVEKCLADYGVERPSMGDVLWNLEYVLQLQDADSSTVSDVNSMNRIVDLSSQVQHVGALESISMTMAEAGASHEPDHDLSDVSMSRVFSQLIKAEGR

SEQ ID NO: 4692 - protein, 521 aa, Triticum aestivum
MACAAYSIRGHLKLAAGHGLASNHLCGGWKPSASCPVSRAWSGNVSSNAVQHVARHYHLTVRNSERWRSIPKASPEDGTAVAEGRMTVLVIGGGGREHALCYALTRSPSCDTVLCAPGNAGIAQSRDAVCISDLDISSSDAVISFCRKRGVGMVVVGPEGPLVAGLANDLVKAGIPTFGPSSEAAALEGSKDFMKRLCDKYNIPTAQYRTFTDPAKAKEYIKDQGAPIVVKADGLAAGKGVVVAMTLDEAFEAIDSMMVDESFGSAGSRVVIEEYLEGEEASFFALVDGENALPLESAQDHKRVGDGDTGPNTGGMGAYSPAPIVTEELKSVIMETIIIPTVKGMAAEGCKFVGVLYAGLMIEKKSGLPKLIEYNVRFGDPECQVLMMRLESDLAQVLLSACRGELGKVSLTWSPEIAMVVVMASEGYPGSYKKGTVIKNIDKAEQVSPAVKIFHAGTALDGDGNLVAVGGRVLGVTAKGKDIEEARFRAYDAVDVVDWPEGFFRRDIGWRALKQEQTANY

SEQ ID NO: 4693 - protein, 521 aa, Triticum aestivum
MACAAYSIRGHLKLATGPGLDSNHLCGGWKPSVSWPVSRAWSSNVSNNAVQHVACHSHLSVRNSERWRSIPKASPEDGTVVAEGRITVLVIGGGGREHALCYALTRSPSCGTVLCAPGNAGIAQSRDAICISDLDISSSDAVVSFCRKRGVGMVVVGPEGPLVAGLANDLVKAGIPTFGPSSEAAALEGSKDFMKRLCDKCNIPTAQYRTFTDPAKAKEYIKNQGAPIVVKADGLAAGKGVVVAMTLDEAFEAINSMMVDESFGSAGSRVVIEEYLEGEEASFFALVDGENALPLESAQDHKRVGDGDTGPNTGGMGAYSPAPIVTEELKSVIMETIIIPTVKGMAAEGCKFVGVLYAGLMIEKKSGLPKLIEYNVRFGDPECQVLMMRLESDLAQVLLSACRGELGKVSLTWSPEIAMVVVMASEGYPGSYKKGTVIKNMDKAEQVSPAVKIFHAGTALDGDGNLVAVGGRVLGVTAKGKDIEEARSRAYDAVDVVDWPEGFFRRDIGWRALKQEQTANY

SEQ ID NO: 4694 - protein, 521 aa, Triticum aestivum
MACAAYSIRGHLKLAAGHGLASNHLRGGWKPSASCPVSRAWSSNVSSNAVQHVARHSHLTVRNSERWRSIPKASPEDGIAVAEGVMTVLVIGGGGREHALCYALTRSPSCQTVLCAPGNAGIAQSRDAVCISDLDISSSDAVISFCRKRGVGMVVVGPEGPLVAGLANDLVKAGIPTFGPSSEAAALEGSKDFMKRLCDKYNIPTAQYRTFTDPAKAKEYIKDQGAPIVVKADGLAAGKGVVVAMALDEAFEAIDSMMVDESFGSAGSRVVIEEYLEGEEASFFALVDGENALPLESAQDHKRVGDGDTGPNTGGMGAYSPAPIVTEELKSVIMETIITPTVKGMAAEGCKFVGVLYAGLMIEKKSGLPKLIEYNVRFGDPECQVLMMRLESDLAQVLLSACRGELGKVSLTWSPEIAMVVVMASEGYPSSYKKGTVIKNIDKAEQVSPAVKIFHAGTALAGDGNLVAVGGRVLGVTAKGKDIEEARSRVYDAVDVVDWPEGFFRRDIGWRALKQEQTANY

SEQ ID NO: 4695 - protein, 521 aa, Secale cereale
MACASYSIRGHLKLATGHGLVNNHLSGGWKPSVSCPVSRAWSSNISSNAVQLVAHHSHLTIRNSARWRSSPKASREDGTIVAEGRIIVLVIGGGGREHALCYALTRSPSCETVLCAPGNAGIAQSRDAICISDLDISSSDAVISFCRKRGVGMVVVGSEGPLVAGLVNDLVKAGIPTFGPSSEAAALEGSKDFMKRLCDKCNIPTAQYRTFTDPAKAKEYIKDQGAPIVVKADGLAAGKGVVVAMTLDEAFEAINSMMVDESFGSAGSRVVIEEYLEGEEASFFALVDGENALPLESAQDHKRVGDGDTGPNTGGMGAYSPAPIVTEELKSVIMETIIIPTVKGMAAEGCKFVGVLYAGLMIEKKSGLPKLIEYNVRFGDPECQVLMMRLESDLAQVLLSACRGELGKVSLTWSPEIAMVVVMASEGYPGSYKKGTVIKNIDKAEQVSPAVKIFHAGTALDGDGNLVAVGGRVLGVTAKGKDIEEARSRAYDAVDAVDWPEGFFRRDIGWRALKQEQTANY

SEQ ID NO: 4696 - protein, 518 aa, Triticum aestivum
MACAAYSIRGYLKLATGHGPVNSHLCGGWKPSVSCPVSRAWSSNVSSNAVQHVACHSHLTVRNSKRWRSIPKASLEDGTVVAEGRITVLVIGGGGREHALCYALTRSPSCETVLCAPGNAGIAQSRDAICISDLDISSSDAVISFCRKRGVGMVVVGPEGPLVAGLANDLVKAGIPTFGPSSEAAALEGSKDFMKRLCDKCNIPTAQYRTFTDPAKAKEYIKDQGAPIVVKADGLAAGKGVVVAMTLDEALEAINSMMVDESFGSAGSRVVIEEYLEGEEASFFALVDGENALPLESAQDHKRVGDGDTGPNTGGMGAYSPAPIVTEELKSLIMETIIIPTVKGMAAEGCKFVGILYAGLMIEKKSGLPKLIEYNVRFGDPECQVLMMRLESDLAQVLLSACRGELGKVSLTWSPEIAMVVVMASEGYPGSYKKGTVIKNTDKAEQVSPAVKIFHAGTALDGDSNLVAVGGRVLGVTAKGKDIEEARSRAYDAVDVVDWPEGFFRRDIGWRALKLTTY

SEQ ID NO: 4697 - protein, 521 aa, Secale cereale
MACASYSIRGHLKLATGHGLVNNHLSGGWKPSVSCPVSRAWSSNISSNAVQLVARHSHLTARNSARWRSSPKASREDGTIVAEGRIIVLVIGGGGREHALCYALTRSPSCETVLCAPGNAGIAQSRDAICISDLDISSSDAVISFCRKRGVGMVVVGPEGPLVAGLVNDLVKAGIPTFGPSSEAAALEGSKDFMKRLCDKCNIPTAQYRTFTDPAEAKQYVKDQGAPIVVKADGLAAGKGVVVAMTLDEAFEAINSMMVEESFGSAGSRVIIEEYLEGEEASFFALVDGENALPLESAQDHKRVGDGDTGPNTGGMGAYSPAPIVTEELKSTIMETIIIPTVKGMAAEGCKFVGVLYAGLMIEKKSGLPKLIEYNVRFGDPECQVLMMRLESDLAQVLLSACRGELGKVSLTWSPEIAMVVVMASEGYPGSYKKGTVIKNIDKAEQVSPAVKIFHAGTALDGDGNLVAVGGRVLGVTAKGKDIEEARSRAYDAVDVVDWPEGFFRRDIGWRALKQEQTASY

SEQ ID NO: 4698 - protein, 478 aa, Triticum aestivum
NVSSNAVQHVARHYHLTVRNSERWRSIPKASPEDGTAVAEGRMTVLVIGGGGREHALCYALTRSPSCGTVLCAPGNAGIAQSRDAICISDLDISSSDAVVSFCRKRGVGMVVVGPEGPLVAGLANDLVKAGIPTFGPSSEAAALEGSKDFMKRLCDKCNIPTAQYRTFTDPAKAKEYIKNQGAPIVVKADGLAAGKGVVVAMTLDEAFEAINSMMVDESFGSAGSRVVIEEYLEGEEASFFALVDGENALPLESAQDHKRVGDGDTGPNTGGMGAYSPAPIVTEELKSVIMETIIIPTVKGMAAEGCKFVGVLYAGLMIEKKSGLPKLIEYNVRFGDPECQVLMMRLESDLAQVLLSACRGELGKVSLTWSPEIAMVVVMASEGYPGSYKKGTVIKNIDKAEQVSPAVKIFHAGTALDGDGNLVAVGGRVLGVTAKGKDIEEARSRAYDAVDVVDWPEGFFRRDIGWRALKQEQTANY

SEQ ID NO: 4699 - protein, 527 aa, Oryza sativa
MASAAAAYGVGAPLKLAARRHGALALAGSHRCSGWKSSVSCPVPQAWMGSCSSVAMRRVASGSRLIVQASNSGGSSLKASLADASLLTEERITVLVIGGGGREHALCYALNRSPSCDAVLCAPGNAGIAQSGDATCISDLDVSDSDAVIAFCCKRGVGMVVVGPEAPLVAGLVNDLVKAEIPAFGPSSEAAALEGSKDFMKKLCDKYNIPTAKYRTFTDPAEAKQYVKDQGAPIVVKADGLAAGKGVVVAMTLDEAFEAIDSMLVQGSFGSAGSRVIIEEYLEGEEASFFALVDGENALPLESAQDHKRVGDGDVGPNTGGMGAYSPAPIVTEELKHTIMDSIIIPTVQGMAAEGCKFVGVLYAGLMIEKKSGLPKLIEYNVRFGDPECQVLMMRLESDLAQVLMSACRGELGDVSLTWSPEMAMVVVMASEGYPGSYKKGTVIRNLEKAEQVSPAVKIFHAGTALDGDGNLVAVGGRVLGITAKGKDIEEARARAYDAVDVVDWPEGFFRRDIGWRALKHKQVANY

SEQ ID NO: 4700 - protein, 521 aa, Sorghum bicolor
MACAAYSIRGPLKLAARHRLDVLTSNNSCNGFKSSVSYPVAQRWSSNCSSITMRHVASHHHLIVKASAMLHSKASATDAATASDERITVLVIGGGGREHALCHALNHSPSCAAVLCAPGNAGIAQSGDATCISDLDISSSDDVISFCRNRGVGMVVVGPEAPLVAGLANDLVKVGIPTFGPTSEAAALEGSKDFMKKLCDKYDIPTAKYRTFTDAVEAKKYVKNEGAPIVVKADGLAAGKGVVVAMTLDEALEAIDSMLVEGSFGSAGSRVIIEEFLEGEEASFFALVDGENALPLESAQDHKRVGDGDVGPNTGGMGAYSPAPIVTDELKRIVMESIIIPTVKGMAAEGCKFVGVLYAGLMIEKKSGLPKLIEYNVRFGDPECQVLMMRLESDLAQVLLSACQGELGNVSLTWSPEMAMVVVMASQGYPGSYKKGTVIKNVDKAEQVSPAVKIFHAGTALDGDGNLVAVGGRVLGVTAKGKDIEEARARAYDAVDAVQWPEGFFRRDIGWRALKQKQVAN

SEQ ID NO: 4701 - protein, 522 aa, Setaria italica
MAYTAYSIRGPLKLAARHGSDVYYSCNGFKSSVSYPVAQGWSRNWSSVATRHVTSHCQLSVRASARWRSTLKASATDAGIVTDEKITVLVIGGGGREHALCYALNRSPSCNAVLCAPGNVGIAQSGDATCISDLDISSSNDVISFCRKRGVGMVVVGPEAPLVAGLANDLVKVGIPTFGPSSEAAALEGSKDFMKKLCDKYNIPTAKYRTFTDAVEAKNYVKHEGAPIVVKADGLAAGKGVVVAMTLDEAFEAIDSMLVEGSFGSAGSRVIIEEFLEGEEASFFALVDGENALPLESAQDHKRVGDGDVGPNTGGMGAYSPAPIVTDELKHIIMESIIIPTVKGMAAEGCKFVGVLYAGLMIEKKSGLPKLIEYNVRFGDPECQVLMMRLESDLAQVLLSACRGDLGNVSVTWSPEMAMVVVMASQGYPGSYKKGTVIKNLDKAEQVSPAVKIFHAGTALDGDGNLVAVGGRVLGVTAKGNDIEEARARAYDAVDAVDWPEGFVRRDIGWRALMHKEAVNYS

SEQ ID NO: 4702 - protein, 522 aa, Zea mays
MACAAYSIRSPLKLAVRHGSDVLSSNNLCNGFKSSVSYLNSQRWSSNCSAVTMRHVASHCHSIVKTPAMWPSKASATDAATASDERITVLVIGGGGREHALCYALNHSPSCAAVLCAPGNAGIAQSRDATCIPDLDISSSDDVISFCRKRGVGMVVVGPEAPLVAGLANDLVKVGIPTFGPSSEAAALEGSKDFMKKLCDKYNIPTAKYHTFTDAVEAKKYVKNEGAPIVVKADGLAAGKGVVVAMTLDEALEAIDSMLVEGSFGSAGSRVIIEEFLEGEEASFFALVDGENALPLESAQDHKRVGDGDVGPNTGGMGAYSPAPIVTDELKRIVMESIIIPTVKGMAAEGCKFVGVLYAGLMIEKKSGLPKLIEYNVRFGDPECQVLMMRLESDLAQVLLSACKGELSNVSLTWSPEMAMVVVMASQGYPGSYKKGTVIKNVDKAERVSPAVKIFHAGTAVDGDGNLVAVGGRVLGFTAKGKDIEEARARAYGAVDAIEWVEGFCRRDIGWRALRQKQVANQ

SEQ ID NO: 4703 - protein, 517 aa, Panicum virgatum
MASVACSIRGPLKLAATCGTAAVYYSCNGYRTWVSYPVAQGWSSNCSSVATRHVASHCQLSVRASARWQSNLKASATDAGIVSDEKITVLVIGGGGREHALCYALNRSPSCTAVLCAPGNAGIAQSGDATCIPDLDISSSDDVISFCRKRGVEMVVVGPEAPLVAGLANDLVRVGIPTFGPSSEAAALEGSKDFMKKLCDKYNIPTAKYRTFTDATEAKKYVKHEGAPIVVKADGLAAGKGVVVAMTLDEAFEAIDSMLVEGSFGSAGSRVIIEEFLEGEEASFFALVDGENALPLESAQDHKRVGDGDVGPNTGGMGAYSPAPIVTDELKRMVMENIIIPTVKGMAAEGCKFVGVLYAGLMIEKKSGLPKLIEYNVRFGDPECQVLMMRLESDLAQVLLSACQGELQNVSLSWSSEMAMVVVMASQGYPGSYIKGTVIKNLDKAEQVSPAVKIFHAGTALDGDGNLVAVGGRVLGVTAKGKDIEEARERAYDAVDAVDWPEGFFRRDIGWRALRHS

SEQ ID NO: 4704 - protein, 323 aa, Panicum virgatum
MKKLCDKYNIPTAKYQTFTDAAEAKKYVKHEGAPIVVKADGLAAGKGVVVAMTLDEAFEAIDSMLVEGSFGSAGSRVIIEEFLEGEEASFFALVDGENALPLESAQDHKRVGDGDVGPNTGGMGAYSPAPIVTDELKRMVMENLIIPTVKGMAAEGCKFVGVLYAGLMIEKKSGLPKLIEYNVRFGDPECQVLMMRLESDLAQVLLSACQGELRNVSLSWSSKMAMVVVMASQGYPESYMKGTVIKNLDKAEQVSPAVKIFHAGTALDGDGNLVAVGGRVLGVTAKGKDIEEARERAYDAVDAVDWPEGFFRRDIGWRALRHS

SEQ ID NO: 4705 - protein, 858 aa, Sorghum bicolor
MRPLRRSSGDLAAFGCCLFLLLPLLSRGADMPVGSTLSPGNSATWTSPNSTFSLGFTASASSPSLFVAAISYAGGVPVWSAGDGAAVDSRGSLRLSSNGDLQLVNGSGTVLWSTNTGGQNVSAAAVQESGNLVLKDSRGATLWQSFDHPTDTVVMSQNFTSGMNLTSGSYVFSVDKATGNLTLRWTSAATTVTYFNKGYNTSFTGNKTLTSPTLTMQTNGIVSLTDGTLTSPVVVAYSSNYGESGDMMRFVRLDADGNFRAYSAARGSNTATEQWSAVADQCQVFGYCGNMGVCSYNGTAPVCGCPSQNFQLTDASKPRGGCTRKADLASCPGNSTMLQLDNTQFLTYPPEITTEQFFVGITACRLNCLSGSSCVASTALSDGSGLCFLKVSNFVSGYQSAALPSTSFVKVCYPPQPNPVPGSTTGAPSRGGPGVRAWVVAVVVLAVVSGLVLCEWALWWFFCRHSPKFGPASAQYALLEYASGAPVQFSYREMQRSTKGFKEKLGAGGFGAVYRGVLANRTVVAVKQLEGIEQGEKQFRMEVATISSTHHLNLVRLIGFCSEGRHRLLVYEFMKNGSLDAFLFGGDRDAPPPGGKMPWPTRFAVAVGTARGITYLHEECRDCIVHCDIKPENILLDEHFNAKVSDFGLAKLVNPKDHRHRTLTSVRGTRGYLAPEWLANLPITAKSDVYSYGMVLLETVSGRRNFDVSEETGRKKFSVWAYEEYERGNLAGIVDRRLPAEDLDMAQVERAVQVSFWCIQEQPAQRPSMGKVVQMLEGVMELERPPPPKSSDSFLSTTTATSAVSSSMVSTVVSSGAPVAPAPSPTLEQEMALGRSESARNRERVSRQLLSPQPYMTM

SEQ ID NO: 4706 - protein, 325 aa, Triticum aestivum
PHGAACVRLMCSFGGRILPRPGDHRLRYVGGETRIVSVPRTTSHAVLFAALAKLAPALFVPGEPTPALRYQLPHDDLDALISVSSDDDVDNLMEELDRVHSLAATAIKPPRLRLFLFAASPDHPSAGAFGSVLSGVGDASSDQWFVDQLNAPPPGSIERGRSEASSIVSEVPDYLFGFDTTSEEPSPGAGAQPKSDAEVAQGDDDDDAPAPVLGAPLVPYVPESAPWPAPPPPYMAQPVYYVPVRPVHYLNAAAHGGYMPGPVYHIVGGGRNEGPGDLYSSGGVGGVYGVPRSMPPFRQVMYAPPPATEAYSVEGKPPEGESHSP

SEQ ID NO: 4707 - protein, 346 aa, Triticum aestivum
MGRTLDVLLGRTTKQTARLKSLLHLATKRIAVVRAHREVRCAQARGDVEQLLRQGHPDRALLRAEQVIRERGTLDALLLLDAYCALLADRSALLDDAHRDCPDELREAAAGLCYAAARCGDLPELQEARALLAARFGRGFASGAAELRAGCGVNAKLVQRLSTALPSLESRQMVLLEIGADKDIPVRLHSDAADSYEDPAGRSHHGHGHRKKRHDDDDERRHATPRAEEPEGDKAATKLTFKDVEEAAQAAFESAATAAAAAKAAIELSRAGSGSTDDRHRRNPGRAHADDEMLHGGEDLADAKKFGRIGHVRNYSSDAEDLPEERGEEQDTPRSRPASVRTNRRL

SEQ ID NO: 4708 - protein, 348 aa, Secale cereale
RTLDVLLGRTTKQTARLKSLLGLATKRIAVVRAHREVRCAQARGDVEQLLRQGHPDRALLRAEQVIRERDTLDVLLLLDAYCALLADRSALLDDARRDCPGELREAAAGLCYAAARCGDLPELQEARALLAAKFGRGFASGAAELRAGCGVNAKLVQRLSTALPSLETRQMVLLEIGADKDIPVRLHSDAASYDHEDPAGRSHHGHGHGHRKKRHDDDDDDDERRHATPRADDDNTDSPRTFKDVEEAAQAAFESAATAAAAAKAAIELSRAGPGSPDDRYRRNPGRAHADDEMLHGGDDLADDKAFKRIGHVRNHSSDAEDLPEKKRGEEQDTPRSRPASVRTNRRL

SEQ ID NO: 4709 - protein, 1467 aa, Secale cereale
AAGKTIEEMYQKKTQLEHILLRPDTYVGSVQKHTQTLWVYEDGAMVNRPVSYVPGLYKIFDEILVNAADNKQRDPSMDSLKVDIDVEGCCISIYNNGDGVPVEIHQEEGVYVPEMIFGHLLTSSNYDDNERKTTGGRNGYGAKLANIFSTEFVIETADGHRLKRYRQVFSENMGKKSEPEIKKCKQSENWTRVTFKPDLEKFNMTELEADVVALMRKRVVDMAGTLGKTVKVELNDEKVSVKSFSDYVQLYINSASKEGIELPRIYQKINDRWEVCVSLSEGQFQQVSFVNGIATIRGGTHVDYVANQVASHVMGVVNKKNKQANMKLHTVKGYLWVFVNALIDNPAFDSQTKETLTTRQANFGSTCELSDEFLKKVSSSGVVTNLLSWAEFKLSKELKKTDGTKRTSILGIPKLEDANDAGGKNSDKCTLILTEGDSAKALAMAGIGVVGRDHYGVFPLRGKLLNVREASHKQLMENAEIQNIKKILGLQHEKNYDSTKGLRYGHLMIMTDQDHDGSHIKGLLINFIHKEWPSLLKVPSFLVEFITPIIKATKGKTVRPFYSMPDYEAWKESLGASASSWTIKYYKGLGTSTAEEGRDYFEHITLHKKDFVWADDKEDCEAIELAFSKKKIAERKDWLTNYQPGTCLDQREKRIKYSDFINKELILFSMADLERSIPSMVDGFKPGQRKILFCSFKKNLIKESKVAQFIGYVSEHSAYHHGEQSLASTIVGMAQDFVGSNNINLLEPRGQFGTRNSGGKDAASARYIFTRLQPITRIIFPKDDDVLLNYLNEDGQSIEPSWYLPIIPMVLVNGSEGIGTGWSTFVPNYNPRDIIANLKRLLNEETIVPMVPWYRGFKGSLKETSSKATGVTYTITGVIEEVADTKLKITELPVRRWTTDYKEFLESMCPIPIKEKEKSKDKNKEKKKDKDKDKEKEKEKSKEPPLLEEIRSQCDHADVEFELILTEQNMNIAKQEGLEKKFKLTTTIGTTNMHLFDSHGKIKKYDTPEDVLQEFFHLRFDFYVRRKKVMLENMASELLKYQNKVRFILAVISGEIIVNNRKRADLFKELKDMNYDPFPKKKPTSEPVAVGSTEGDEDNDESPVEAAGSGYEYLLAMSIGTLTMEKVKELIAQQDKVKEDLKILGNTAPKTLWLRDLDALEKELDVLDAKLEAEQNNRSSKRAKNSEDAKQSKAAAKKQPKKAAAKSQKANLAGSDDDDYEAAIPKPAAQKKKPPPKKASAPVKDEVKDEEDEVAELKDRLAAYNIHSDNSPEPSAMETEEQHKGKKGRNGPSKRGAAKKAMSSFAEISDEDVAEPPHESDDGGSSMEVEKKTKGRKPAAEKPKTTIRKRAPAQTKGMRQKVMEEIFKPTDDSTLSAPSPEKKVRRIRDSPFNKKSGSVLHRMASASTGTEDGEAPPSGSSAEPVAPRRTTRERKAAVVYVASGSEDDESEDEDVSEPSDDDFSEDD

SEQ ID NO: 4710 - protein, 392 aa, Setaria italica
MEIQSSGRSIDVLMEKVLSVNILSSDYFKELYKFKTYHEVVDEIYHQVDHVEPWMTGNCRGPSSAFCLLYKFFTMKLTVNQMHGLLKHPDSPYIRAIGFLYLRYVAEPKTLWAWYEPYIKDDEEFSPGSNGKMTTMGVYVRDLLLGQYYFDSLLPRVPLPILRQVTSHLEKLKLPTKQSGMTGDSNRHESNDTARRPPSVKASLSVSFGQRAPHRASTRDSSPVRRTLPSKQEKERSYDGDRARSPPRKRRSRSRERDHDSERDRSDRDRGRYKDRDYDRRARDHSDRDHHRSSYSDRDGERRGREKRDRDSDRSGRSSTRRSRSRSPVRGRTEGDKHRSSPFGKAPESSNLAKLKDLYGDATNTKNDSGDDRAHRDSGTEEVIRLGGARWR

SEQ ID NO: 4711 - protein, 506 aa, Setaria italica
MAGRAWRPVLAGAWLLLLLLLLPSASAVRRSDFPASFLFGTATSSYQIEGAYLEGNKSLSNWDVFTHQPGRIKDRSTGDIADDHYHRFEDDVELMHSLGTNAYRFSISWARILPRGRFGRVNLAGIAFYDELIDSLLHKGIEPFVTLTHYDIPQELEDRYGSWLSDEIQRDFGYFADVCFAAFGDRVKYWATFNEPNVAVRKGYMLGTYPPARCSPPYGSCARGDSGAEPYLATHNVVLSHATAVEIYKRKYQSEQKGLIGIVMSTTWFKPMTDAPVDRLATERALAFDVPWFLDPIVYGDYPPEMRQILGSRLPAFSPDERRKLGYKLDFIGVNHYTTLYARDCMFSPGCPLGQETQHALAAVTGERNGLPVGPPTAMPTFYVVPEGIEKIVTYIMKRYNNLPMFITENGYAQGGDGYAHVEDWLDDQGRIEYLDGYLTKLAKVIRDGADVRGYFVWSLIDNFEWLYGYTLRFGLHYVDYQTQERKPKSSALWYQRFLQSLLEAQ

SEQ ID NO: 4712 - protein, 504 aa, Panicum virgatum
MAGGEVWRPLLAGAWLLWLLPWASAVRRSDFPAAFLFGTATSSYQIEGAYLEGNKSLSNWDVLTHLPGRVNDGSTGDIADDHYHRFEDDVELIHSLGTNAYRLSISWARILPRGRFGKVNPAGIEFYNKLIDALLLKGIEPFVTLNHYDIPQELEDRYGAWLSAEIRRDFGHLADVCFAAFGDRVKYWVTFNEPNVVVRKGYMLGTYPPERCSPPYGSCAGGDSGTEPYLATHNIVLAHATAVEIYKRKYQSKQKGLIGIVMSTTWYEPLTDSPEDRLATERVLAFDVPWFLDPIVYGDYPPEMRQLLGSRLPTFSPEERRKLGYKLDFIGVNHYTTLYAKDCMFSAGCPLGQQTQPALVAVTEERNGIPIGPPTPMPTFYVVPDGIAKIVTYVMKRYNNLPMFITENGYAQGGDGYAHVDDWLDDQGRIQYLDAYLTKLAEVIRDGADVRGYFIWSLIDNFEWLYGYTLRFGLHYVDFQTQERKPKSSALWYKRFLQSLHEAQ

SEQ ID NO: 4713 - protein, 516 aa, Sorghum bicolor
MAAAGSWPRASARRLLLAGAYYSLLWLLDLPWATAAVRRSDFPASFLFGTATSSYQIEGAYLEGNKSLSNWDVFTHAPGRIKDRSTGDVADDHYHRYEEDIELMHSLGTNAYRFSISWARVLPKGRFGKVNPAGIAFYNKLIDSLLLKGIEPFVTLTHYDTPQELEDRYGAWLSAEARRDFGHLADVCFAAFGDRVKYWSTFNEPNVVVTRGYMVGTYPPERCSPPLGSCARGNSDAEPYVATHNVVLAHATAVEIYKRKYQSKQKGMIGIVMSALWLVPLTDTPVDRLATERALAFDAPWFLDPIIYGDYPPEMRQLLGSKLPTFSPEERRKLGYKLDFIGINHYTTLYAKDCMFSSGCPSSGQEIHHALAAFTGERNGIPIGPPTAMPKFYFVPDGIEKMVTYIMKRYNNLPMFITENGYAQGGDSYTNVEDWLDDQGRIQYLDGYLTKLAKVIRDGADVRGYFVWSLIDNFEWLYGYTLRFGLHYVDYQTQERKPKSSALWYKRFLQSFVEAQ

SEQ ID NO: 4714 - protein, 510 aa, Sorghum bicolor
MAGRARARRLMLAGALLLLLGLLDLPWATAAVRRSDFPASFLFGTATSSYQIEGAYLEGNKSLSNWDVFTHIPGRIEDGSTGDTADDHYHRFEDDVELMHSLGTNAYRFSISWARILPRGRFGQVNPEGIAFYNKLIDSLLLKGIEPFVTLAHYDIPQELVDRYGAWLSTEVQRDFGYLADVCFAAFGDRVKHWATFNEPNVAMTKGYMLGTYPPGRCSPPFGSCAQGNSDAEPYVATHNVVLSHATAVEIYKRKYQRKQKGMIGIVMAAFWFVPLTDTPVDRMATERALAFSVPWYLDPIVYGDYPPEMRQLLGSKLPTFSPVEKRKLGYKLDFIGINHYTTLYVKDCMFTSGCPSGQDIQYALAAYTGERNGIPIGPPTAMPLFFDVPDGIEKMVTYIMKRYNNLPMFITENGYAQGGVGYNQVEDWLDDQSRIQYLDGYLTKLAKVIRDGADVRGYFIWSLIDNFEWTYGYTLRFGLHYVDYQTQERKPKSSALWYKRFLQSLHEAQ

SEQ ID NO: 4715 - protein, 502 aa, Panicum virgatum
MAIPSHAVPLRALLVGLPLLSLFIVFHLLHRPAQPLPPPIRTHAHAHARPSSAAAAEEVVVGSPSSTAPPASRHRPEPETEPTSLRHVVFGIASSRRTLPLRLPLLRLWLRAPTRAFLFLDAPAPAPAAGGLPCGLALRVSADASRFPYTHPRGLPSAVRVARIAGELVAALEKEEEGRRAPPRWLVLADDDTAFVLPNLLRALRGYDHREPWYLGSRSESAAQNAWHGFAMAYGGAGIAVSWPLARRLARALDSCVLRYPHLYGSDARIYACLAELGVELTHEPGFHQIDLHGDISGLLRAHPLSPLVSLHHLDHVHPLYPGMDRTRAMKHFFRAANADPARILQQTVCYDRKRSLTVSIAWGYSVQVFKGNVLLPDLLAVQKTFVPWKRGRNVTDVYMFNTKHVPRDECKRGALFFLKSISSGEGKTETTYNRQPPRKCSHDLIPLRNLSLIKVTAEQLQLVPGKALRRHCCDIVPSSSDTTMDINIRKCKDDELIAMHS

SEQ ID NO: 4716 - protein, 491 aa, Panicum virgatum
MATPSHAVPLRALLVGLPLLSLLIVFHLLHRPAPLPLPLRARAEALVDPPPSTTPPPASRHRPEPETEPTSLRHVVFGIASSRRTLPLRIPLLRLWLRAPARAFLFLDAPAPAPVVAGGLPRGLALRVSADASRFPYTHPRGLPSAVRVARIAGELVAALEKEEGEGRRPPPRWLVLADDDTAFVLPNLLRALRGYDHREPWYLGSRSESAAQNAWHGFAMAYGGAGIAVSWPLARRLARALDSCVLRYPHLYGSDARIYACLAELGVELTHEPGFHQIDLHGDISGLLRAHPLSALVSLHHLDHVYPLYPGMDRTRAMKHFFQAANADPARILQQTVCYDRKRSLTVSIAWGYSVQVFKGNVLLPDLLAVQKTFVPWKRGRNVTDVYMFNTKHVPRDECKRGALFFLKSISSGDGKTETTYNRQPPRKCSHDLIPLRNLSLIKVTAEQLQLVPGKALRRHCCDIVPSSSDTTMDINIRKCKDDELIAMHS

SEQ ID NO: 4717 - protein, 505 aa, Sorghum bicolor
MATPSSHGIPLRALLLVLPLLSILIVFQLLHRPAPLPPPLLRTHADAAASHSHRAEEEPSSPPLTSNVPPPPAPKPEESSSEPTSLRHVVFGIASSKRTLPLRLPLLRLWLRAPARAFLFLDAPAPHADADARDLPPGLALRVSADASRFPYTHPRGLPSAVRVARIAGELVSALKQEREEEDVRWLVLADDDTAFVLPNLVHTLRRYDHREPWYLGARSESAAQNAWHGFAMAYGGGGIAVSWPLARRLARVVDSCVLRYPHLYGSDARIYACLAELGVELTHEPGFHQIDLHGDISGLLRAHPLSPLVSLHHLDHVYPLYPGMDRTRAMQHFFQAADTDPARILQQTVCYDQKNSLTVSVSWGYSVQVFKGNVLLPDLLAVQKTFVPWKRGRNVTDVYMFDTKHYPRDECKRGALFFLKSITSGEGKTKTESTYNRQPPRKCPPDLIPLKNLRLIKVTSERLQLAPGKALRRHCCDIAPSSSDNNIDINIRKCEDDELIAMHS

SEQ ID NO: 4718 - protein, 493 aa, Zea mays
MSTPYHGIPLRALLLAVPLISIFIVFHLLYRPAPLPSTFRTYADGAASHRAEELSCPPLSSNLPPPAPKPEETLEPTSLRHVVFGIASSRRTLPLRLPLLRLWLRAPARAFLFLDAPAPAPDARDLPPGLALRVSADASRFPYTHPRGLSSAVRVARIAGELVSGLKQGEGEDVRWLVLADDDTAFVLPNLLHTLRRYDHREHWYLGARSESAAQNAWHAFAMAYGGGGIAVSWPLARRLARVVDSCVLRYPHLYGSDARIYACLAELGVELTHEPGFHQIDLHGDISGLLRAHPLSPLVSLHHLDHVYPLYPGMDRARAMRHFFRAADADPARILQQTVCYDRKESLTVSVSWGYSVQVFKGNVLLPDLLAVQKTFVPWKRGRNVTDVYMFNTKHYPRDECKRGALFFLKGITSREGKTETTYNRQPPRKCPPDLIPLKSLRLIKVTSERLQLAPGKALRRHCCDIVPSSSDANIDINVRKCRDDELIAMHS

SEQ ID NO: 4719 - protein, 707 aa, Setaria italica
MSAGFVGVVVSDPSLQGQFTQVELRSLKAKFVSLKRDSGHVTTKNLPGLMKKLRGLNEVVSEEEIAAFLSESYPDSDQEIEFESFLREYLNLQARVSAKVGGGAGGGGGKTSSSFLKSSTTTLLHNLNQAEKSSYVAHINTYLREDPFLRKYLPIDPSGNQLFDLIRDGVLLCKLINVAVPGTIDERAINKKRVLNPWERNENHTLCLNSAKAIGCTVVNIGTQDLVEGRPHLVLGLISQIIKIQLLADLNLKKTPQLVELFDDSKDIDEVLSLSPEKMLLRWMNHHLKKAGYKKTVNNFSSDVKDGEAYAYLLKALAPEHSPETTLDTKDPDERAKLVLEQAEKLDCKRYLTPKDITEGSANLNLAFVAQIFQHRNGLTSDTKQVTLTQTATRDDVLLSREERAFRMWINSLGVESYVNNVFEDVRNGWVLLEVLDKVSPGSVNWKLASKPPIKLPFRKLENCNQVVKIGKELKFSLVNLAGNDIVQGNKKLIVALLWQLMRFNILQLLNKLRFHSQGSQGKEITDADILNWANSKVKASGRTSRMESFKDKSLSNGLFFLELLSAVQPRVVNWKVVTKGEADEDKKLNATYIISVARKLGCSVFLLPEDIIEVNQKMILTLTASIMYWSLQKQPQSQSEMPEQSEPSSMTSDAASDIASEDGASTTAPSESEEVNSLSDSMSNLTTDDATSNAPSTENGNGVAGS

SEQ ID NO: 4720 - protein, 704 aa, Sorghum bicolor
MSGFVGVVVSDPSLQGQFTQVELRSLKAKFVSLKRDSGHVTTKNLPGLMKKLRGLNEVVSEEEIAAFLSESYPDSDQEIEFESFLRAYLNLQARVSAKQGGAGGGGGGKSSFLKSTITTLLHNLNQAEKSSYVAHINTYLREDPFLKKYLPIDPSGNQLFDLIRDGVLLCKLINVAVPGTIDERAINKKRVLNPWERNENHTLCLNSAKAIGCTVVNIGTQDLVEGRPHLILGLISQIIKIQLLADLNLKKTPQLVELFDDSKDIDEVLSLSPEKMLLRWMNHHLKKAGYKKTVNNFSSDVKDGEAYAYLLKALAPEHSPETTLDIKDPNERAKLVLEQAEKLDCKRYLTPKDITEGSANLNLAFVAQIFQHRNGLTSDTKQVTLSQTATRDDVLLSREERAFRMWINSLGVESYVNNVFEDVRNGWVLLEVLDKVSPGSVNWKLATKPPIKLPFRKLENCNQVVKIGKQLKFSLVNLAGNDIVQGNKKLIVALLWQLMRFNILQLLNKLRFHSQGAQGKEISDADILDWANSKVKASGRTSRMESFKDKSLSNGLFFLELLSTVQPRVVNWKVVTKGEADEDKKLNATYIISIARKIGCSVFLLPEDIVEVNQKMILTLTASIMYWSLQRQPQSQSEMPEQSEPSSMTSDAASDIASEDGASTTAPSESEEVNSLSDSISNLTMDDATSNAPPAENGNGVEGS

SEQ ID NO: 4721 - protein, 705 aa, Zea mays
MSGFVGVVVSDPSLQGQFTQVELRSLKAKFVSLKRDSGHVTTKNLPVMMKKLRGLNEVVSVEEIAAFLSESYPDSDQEIEFESFLREYLNLQARVSAKEGGAGGGRGGKSSFLKSSTTTLLHNLNQAEKSSYVAHINTYLREDPFLKKYLPMDPSGNQLFDLIRDGVLLCKLINVAVPGTIDERAINKKRVLNPWERNENHTLCLNSAKAIGCTVVNIGTQDLVEGRPHLVLGLISQIIKIQLLADLNLKKTPQLVELFDDSKDIDEVLSLSPEKMLLRWMNHHLKKAGYKKTVNNFSSDVKDGEAYAYLLKALAPEHSPETTLDTKDPNERAKLVLEQAAKLDCKRYLTPKDITEGSANLNLAFVAQIFQHRNGLTSDTKQVTLTQTATPDDVLVSREERAFRMWINSLGVESYVNNVFEDVRNGWVLLEVLDKVSPGSVNWKLATKPPIKLPFRKLENCNQVVKIGKQLKFSLVNLAGNDIVQGNKKLIVALLWQLMRFNILQLLNKLRFHSQGGSQGKEISDADILDWANSKVKASGRTSRMESFKDKSLSNGLFFLELLSTVQPRVVNWKVVTKGETDEDKKLNATYIISVARKIGCSVFLLPEDIVEVNQKMILTLTASIMYWSLQNQHQSQSEMPEQSEPSSMASDAASDIASEDGASTTAPSELDEVNSLSDSVSNLTTDDATSNAPSTENGNGVAGS

SEQ ID NO: 4722 - protein, 706 aa, Panicum virgatum
MSAGFVGVVVSDPSLQGQFTQVELRSLKAKFVSLKRDSGHVTTKNLPGLMKKLRGLNEVVSEEEIAAFLSESYPDSDQEIEFESFLREYLNLQARVSAKEGGAGAGGGGGKTSFLKSSITTLLHNINQAEKSSYVAHINTYLRDDPFLKKYLPIDPAGNQLFDLIRDGVLLCKLINVAVPGTIDERAINKKRVLNPWQRNENHTLCLNSAKAIGCTVVNIGTQDLVEGRPHLVLGLISQIIKIQLLADLNLKKTPQLVELFDDSKDIDEVLSLSPEKMLLRWMNHHLKKAGYKKIVNNFSSDVKDGEAYAYLLKALAPEHSPETTLDTKDPEERAKLVLEQAEKLDCKRYLTPKDITEGSANLNLAFVAQIFQHRNGLTSDTKQVTLTQTATRDDVLLSREERAFRMWINSLGVESYVNNVFEDVRNGWVLLEVLDKVSPGSVNWKLATKPPIKLPFRKLENCNQVIKIGKQLKFSLVNLAGNDIVQGNKKLIVALLWQLMRFNILQLLNKLRFHSQGPQGKEITDADILNWANSKVKASGRTSRMESFKDKSLSNGLFFLELLSAVQPRVVNWKVVTKGETDEDKKLNATYIISVARKLGCSVFLLPEDIIEVNQKMILTLTASIMYWSLQKQPQSPSEMPEQSDPSSMASDAASDVGSEDGASTIAPSESEDVNSLSDSISNLTMDDATSIAPSTENGNVVAES

SEQ ID NO: 4723 - protein, 707 aa, Pennisetum glaucum
MSAGFVGVVVSDPSLQGQFTQVELRSLKAKFVSLKRDSGHVTTKNLPALMKKLRGLNEVVSEEEIAAFLSETYPDSDQEIEFESFLREYLNLQARVSAKAGGGGAGGGGGKNSSSFLKSSTTTLLHNLNQAEKSSYVAHINTYLREDPFLRKYLPIDPSGNQLFDLIRDGVLLCKLINVAVPGTIDERAINKKRVLNPWERNENHTLCLNSAKAIGCTVVNIGTQDLVEGRPHLVLGLISQIIKIQLLADLNLKKTPQLVELFDDSKDIDEVLSLSPEKMLLRWMNHHLKKAGYKKTVNNFSSDVKDGEAYAYLLKALAPEHSPETTLDTKDPEQRAKLVLEQAEKLDCKRYLTPKDITEGSANLNLAFVAQIFQHRNGLTSDTKQVTLTQTATRDDVLLSREERAFRMWINSLGVESYVNNVFEDIRNGWVLLEVLDKVSPGSVNWKLASKPPIKLPFRKLENCNQVIKIGKELKFSLVNLAGNDIVQGNKKLIVALLWQLMRFNILQLLNKLRFHSQGSQGKEITDADILNWANSKVKASGRTSRMESFKDKSLSNGLFFLELLSAVQPRVVNWKVVAKGEADEDKKLNATYIISVARKLGCSVFLLPEDIVEVNQKMILTLTASIMYWSLQKPQSQSEMAEQSEPSSMTSDAASDIASEDGASTTAPSESEEVNSLSDSVSNLTMDDATSNAPSTENGNGVAGS

SEQ ID NO: 4724 - protein, 733 aa, Secale cereale
MSGFVGVVVSDPSLQGQFTQVELRSLKAKFVSLKRDSGHVTTKNLPGLMKKLRGLHEVVSEEEIAAFLLESYPDSDQEIEFEAFLREYLNLQARVSAKEGSAAAAGGGGAGGRKNSSSFLKSTITTLLHNLNQAEKSSYVAHINTYLGEDPFLKKYLPIDPSGNQLFDLIRDGVLLCKLINVAVPGTIDERAINKKRVLNPWERNENHTLCLNSAKAIGCTVVNIGTQDLVEGRPHLVLGLISQIIKIQLLADLNLKKTPQLVELFDDSKDIDEVLSLSPEKMLLRWMNHHLKKAGYKKTVNNFSSDVKDGEAYAYLLKALAPETSPETTLETKDPDERAKMVLEQAEKLDCKRYLTPKDITEGSANLNLAFVAQIFQHRNGLTSDIKQVTLTQTASRDDVLVSREERAFRMWINSLGVESYVNNVFEDVRNGWVLLEVLDKVSPGSVNWKLASKPPIKLPFRKLENCNQVVKIGKELKFSLVNLAGNDIVQGNKKLIVALLWQLMRFNILQLLNRLRSHSKGSQGKQITDADILNWANSKVKASGRTSRMESFKDKSLSNGVFFLELLSAVQPRVVNWKVVTKGEADEEKKLNATYIISVARKLGCSVFLLPEDIIEVNQKMILTLTASIMYWSLLRQPQPEISEASEPSSMASDATSDIGSEDGASTAAPSEGEEVNSLSDTMSTLTTDDASSNAPPAENGSDASSNASPAENGTDASSNAPPAENGNDAT

SEQ ID NO: 4725 - protein, 746 aa, Hordeum vulgare
MSGFVGVVVSDPSLQGQFTQVELRSLKAKFVSLKRDSGHVTTKNLPGLMKKLRGLHEVVAEEEIAAFLSESYPDSDQEIEFESFLREYLNLQARVSAKEGNAAAAGGGGAGGRKNSSSFLKSTITTLLHNLNQAEKSSYVAHINTYLGEDPFLKKYLPIDPSGNQLFDLIRDGVLLCKLINVAVPGTIDERAINKKRVLNPWERNENHTLCLNSAKAIGCTVVNIGTQDLVEGRPHLVLGLISQIIKIQLLADLNLKKTPQLVELFDDSKDIDEVLSLSPEKMLLRWMNHHLKKAGYKKTVNNFSSDVKDGEAYAYLLKALAPETSPETTLETKDPDERAKMVLEQAEKLDCKRYLTPKDITEGSANLNLAFVAQIFQHRNGLTSDIKQVTLTQTASRDDVLVSREERAFRMWINSLGVESYVNNVFEDVRNGWVLLEVLDKVSPGSVNWKLASKPPIKLPFRKLENCNQVVKIGKELKFSLVNLAGNDIVQGNKKLIVALLWQLMRFNILQLLNRLRSHSKGSQGKQITDADILNWANSKVKASGRTSRMESFKDKSLSNGVFFLELLSAVQPRVVNWKVVTKGEADEEKKLNATYIISVARKLGCSVFLLPEDIIEVNQKMILTLTASIMYWSLLRQPQPEISEASEPSSMASDATSDIGSEDGASTAAPSESEEANSLSDSLSTLTTDDATSNAPAAENGNDATPNALPAGNGNDATPNAPPAENGNDATPNAPPAENGNNAT

SEQ ID NO: 4726 - protein, 619 aa, Panicum virgatum
MSTGFVGVVVSDPSLQGQFTQVELRSLKAKFVSLKRDSGHVTTKNLPGLMKKLRGLNEVVSEEEIAAFLSESYPDSDQEIEFESFLREYLNLQARVSAKEGGGGSAGGGGGKTSFLKSSITTLLHNINQAEKSSYVAHINTYLRYDPFLKKYLPIDPAGNQLFDLIRDGVLLCKLINVAVPGTIDERAINKKRVLNPWQRNENHTLCLNSAKAIGCTVVNIGTQDLVEGRPHLVLGLISQIIKIQLLADLNLKKTPQLVELFDDSKDIDEVLSLSPEKMLLRWMNHHLKKAGYKKTVNNFSSDVKDGEAYAYLLKALAPEHSPETTLDTKDPDERAKLILEQAEKLDCKRYLTPKDITEGSANLNLAFVAQIFQHRNGLTSDTKQVTLTQTATRDDVLLSREERAFRMWINSLGVESYVNNVFEDVRNGWVLLEVLDKVSPGSVNWKLATKPPIKMPFRKLENCNQVIKIGKQLKFSLVNLAGNDIVQGNKKLIVALLWQLMRFNILQLLNKLRFHSQGSQGKEITDADILNWANSKVKASGRTSRMESFKDKSLSNGLFFLELLSAVQPRVVNWKVVTKGEADEDKKLNATYIISVARKLGCSVFLLPEDIIEVNRYC

SEQ ID NO: 4727 - protein, 715 aa, Triticum aestivum
VSLKRDSGHVTTKNLPGLMKKLRGLHEVVPEEEIAAFLSESYPDSDQEIEFESFLREYLNLQARVSAKEGSATAGGGGAGGRKNSSSFLKSTITTLLHNLNQAEKSSYVAHINTYLGEDPFLKKYLPIDPSGNQLFDLIRDGVLLCKLINVAVPGTIDERAINKKRVLNPWERNENHTLCLNSAKAIGCTVVNIGTQDLVEGRPHLVLGLISQIIKIQLLADLNLKKTPQLVELFDDSKDIDEVLSLSPEKMLLRWMNHHLKKAGYKKTVNNFSSDVKDGEAYAYLLKALAPETSPETTLETKDPDERAKMVLEQAEKLDCKRYLTPKDITEGSANLNLAFVAQIFQHRNGLTSDIKQVTLTQSASRDDVLVSREERAFRMWINSLGVESYVNNVFEDVRNGWVLLEVLDKVSPGSVNWKLASKPPIKLPFRKLENCNQVVKIGKELKFSLVNLAGNDIVQGNKKLIVALLWQLMRFNILQLLNRLRSHSKGSQGKQITDADILNWANSKVKASGRTSRMESFKDKSLSNGVFFLELLSAVQPRVVNWKVVTKGEADEEKKLNATYIISVARKLGCSVFLLPEDIIEVNQKMILTLTASIMYWSLLRQPQPEISEASEPSSMASDATSDIGSEDGASTAAPSESEEANSLSDSLSTLTTDDATSNAPAAENGSDTTSNAPAAENGTGATPDAPPAENGNNATPDAPPAENGNDAT

SEQ ID NO: 4728 - protein, 713 aa, Triticum aestivum
KRDSGHVTTKNLPGLMKKLRGLHEVVPEEEIAAFLSESYPDSDQEIEFESFLREYLNLQARVSAKEGSAAVSGGGGAGGRKNSSSFLKSTITTLLHNLNQAEKSSYVAHINTYLGEDPFLKKYLPIDPSGNQLFDLIRDGVLLCKLINVAVPGTIDERAINKKRVLNPWERNENHTLCLNSAKAIGCTVVNIGTQDLVEGRPHLVLGLISQIIKIQLLADLNLKKTPQLVELFDDSKDIDEVLSLSPEKMLLRWMNHHLKKAGYKKTVNNFSSDVKDGEAYAYLLKALAPETSPETTLETKNPDERAKMVLEQAEKLDCKRYLTPKDITEGSANLNLAFVAQIFQHRNGLTSDIKQVTLTQSASRDDVLVSREERAFRMWINSLGVESYLNNVFEDVRNGWVLLEVLDKVSPGSVNWKLASKPPIKLPFRKLENCNQVVKIGKELKFSLVNLAGNDIVQGNKKLIVALLWQLMRFNILQLLNRLRSHSKGSQGKQITDADILNWANSKVKASGRTSRMESFKDKSLSNGVFFLELLSAVQPRVVNWKVVTKGEADEEKKLNATYIISVARKLGCSVFLLPEDIIEVNQKMILTLTASIMYWSLLRQPQPEISEASEPSSMASDATSDIGSEDGASTAAPSESEEANSLSDSLSTLTTDDATSNAPPAENGNGATPDAPPAENGNDATPDAQPAENGNAATPDAPPAENGNDAT

SEQ ID NO: 4729 - protein, 691 aa, Hordeum vulgare
MSGFVGVVVSDPSLQGHFTQVELRSLKAKFVSLKRESGHVTAKNLPGLMKKLKGLNEVVSEEEIAAFLSEVYPDSDQEIEFEQFLQEYLNLEARVSSKAGASGSKNSWSFLKSSTTTLIHNPNQAEKSSYVAHINAYLGNDPFLKKYLPMDPAGNDLFDLVRDGVVLCKLINVAVPGTIDERAINKKRILNPWERNENHTLCLNSAKAIGCTVVNLGAQDLVEGRTHLVLGLISQIIKIQLLADLNLKKTPQLVEIFDDSKDIDEVLSLSPEKLLLQWMNYHLKRVDYKKTVSNFSSDVKDGEAYAYLIKALAPEHSSVLTFETKDPAVRAKLVLNQAEKLGCKRYLSPKDITEGSPNLNLAFVAQIFQHRNGLSTDTRQVKLTQTSSQDEVILCREERAFRMWINSLGVATYVNNVFEDVRTGWVLLEVLDKVSPGSVNWKLATKPPIKMPFRKLENCNQVIKIGKELKFSLVNLAGNDIVQGNKKLIVALLWQLMRFNILQLLNKLRFHSQGSQGKEITDADILSWANNKVKSSGRNSRMESFKDKNLSSGIFFLELLSAVLPRVVNWKVVSKGVDDDEKKLNATYIISVARKLGCSVFLLPDDIIEVNQKMILTLTASIMYWSLQKPQQPETSEQSESSCAASDAASDIASEDSASIVAPSEGEEVNSLPDGGSSMPSDDTSTSEAPV

SEQ ID NO: 4730 - protein, 214 aa, Triticum aestivum
MSGFVGVVVSDPSLQGHFTQVELRSLKAKFVTLKRESGHVTTKNLPGLMKKLKGLNEVVSEEEIAAFLSEVCPDSDQEIEFEQFLREYLNLQERVSSKAGASGSKNSWSFLKSSTTTLIHHSPNQAEKSSYVAHINAYLGNDPFLKKYLPIDPAGNDLFDLVRDGVVLCKLINVAVPGTIDERAINKKGSLTHGREMRTIRFASTLQRLLDVLL

SEQ ID NO: 4731 - protein, 563 aa, Triticum aestivum
MSGFVGVVVSDPSLQGHFTQVELRSLKAKFVSLKRESGHVTTKNLPGLMKKLKGLNEVVSEEEIAAFLLEVCPDSDQEIEFEQFLREYLNLQERVSSKAGASGSKNSWSFLKSSTTTLIHHSPNQAEKSSYVAHINAYLGNDPFLKKYLPIDPAGNDLFDLVRDGVVLCKLINVAVPGTIDERAINKKRILNPWERNENHTLCLNSAKAIGCTVVNLGAQDLVEGRAHLVLGLISQIIKIQLLADLNLKRTPQLVEIFDDSKDIDEVLSLSPEKLLLQWMNYHLKKAGYKKIVTNFSSDIKDAEAYAYLIKALAPEHSSILAFDTKDPAVRAKVVLDQAEKLGCKRYLSPKDITEGSPNLNLAFVAQIFQHRNGLSTDTRQVTLTQTSSRDEVILCREERAFRMWINSLGIATYVNNVFEDVRNGWVLLEVLDKVCPGYVNWKLATKPPIKMPFRKLENCNQVINIAKDLKFSMVNLAGNDIVQGNKKLIVALLWQLMRFNILQLLNKLRFHSQGSQGKEITDADILSWANNKVKVSGRNSRMESFKDKNLSSGIFSLSFSVL

SEQ ID NO: 4732 - protein, 688 aa, Brachypodium distachyon
MSGFVGVIISDPSLQGQFTQVELRSLKAKYVILKRESGHVTSKNLPGLMKKLRGLNEVVSEDEIAAFLSEVYPDEDKEIEFESFLREYLNLQARVTHKEGGSGAKHSSSFLKSSTTTLLHNPNQAEKSSYVAHINAYLADDPFLKKYLPLDPAGNDLFDLVRDGVVLCKLINVAVPGTIDERAINKKRILNPWERNENHTLCLNSAKAIGCTVVNLGAQDLVEGRTHLVLGLISQIIKIQLLADLNLRKTPQLVEVFDDSRDIDEVLSMSPEKLLLQWMNYHLKRAGYKKTVSNFSSDVKDGEAYTYLIKALAPEHSSETAFETKDPTERAKLVLEQAEKLDCKRYLSPKDITEGSPNLNLAFVAQIFHHRNGLTTDTNQINLTQTSSRDDLILSREERAFRMWINSLGIVTYVNNMFEDVRNGWVLLEVLDKVYPGSVNWKIATKPPIKMPFRKLENCNQVIQIGKQLKFSLVNLAGNDIVQGNKKLIVALLWQLMRFNILQLLNKLRFHSQGSQGKQITDADILNWANNEVKASGRTSQMESFKDKNLSSGIFFLELLSAVQPRVVNWKVVSKGVDDDEKKLNATYIISVARKLGCSVFLLPDDIIEVNQKMILTLAASIMYWSLQKPPQSETSEQSAPSNVASDAASDIASEDSTSIMASLEGEEVNSLPKSMATDNTSTSDALF

SEQ ID NO: 4733 - protein, 532 aa, Sorghum bicolor
MAAESCGSRGASPPPPPPSTGGAAGRRRKAEAYAEVLRRIRAGAGGYGAARPGLEDELWAHFQGLPARYALDVNVERVEDVLLHKKLLEQAHEPMNGLVFDVRPSQVVTLEESTGFESATSFKQEEQDPQCSVFTSRGQRPLHEIIFACDDKPKLLSQLTSLLGELGLNIQEAHAYSTSDGYSLDIFVVDGWKYEADILRSALREGVDKIKYRAWPLVPSMSARMDHQPLEVSPSSDFVQIPADAADVWEVDPRLLKFEQKLASGSFGDLYHGTYCSQDVAIKVLKPERVSVDMLREFAQEVYIMKKVRHKNVVQFIGACTRPPVLCIVTEFMHGGSIFDFLYNRRGNFQLPDVIRIASDVSKGMNYLHQINIVHRDLKTANLLMDDQVVKVADFGVARVKDQSGVMTAETGTYRWMAPEVIEHLPYDHRADVFSFGIVLWELLTGKLPYEDMTPLQAAVAVVQKDLRPIIAADTHPMLANLLQRCWQKDPALRPTFAEIVDILNSIKEVVQSSVHHKRHPGRSHSGRRRGC

SEQ ID NO: 4734 - protein, 534 aa, Setaria italica
MAAESCGSRGASPPPPPSSAGGGGGGAAGRRRKAEAYAEVLRRIRSGGYGGGRPGLEDELWAHFQGLPARYALDVNVERVEDVLLHNKLLEQAREPMNGLVFDVRPSQVVTPEDSTGFESSTSFKQEEQDPQSSAFTSRDQRPLYEIIFACDDKPKLLSQLTLLLGELGLNIQEAHAYSTSDGYSLDIFVVNGWEYEVDILRSALRKGIDKIKYRAWPLVQSMAARMDHRPMEVSPSSDFVQIPADAADVWEVDPRLLKFERKLASGSFGDLYHGTYCSQDVAIKVLKPERVSVDMLREFAQEVYIMKKVRHKNVVQFIGACTRPPISCIVTEFMHGGSIFDFLYNRRGKFQLPDVIRIASDISKGMNYLHQINIVHRDLKTANLLMDDQVVKVADFGVARVKDQSGVMTAETGTYRWMAPEVIEHLPYDHSADVFSFGIVLWELLTGKLPYEDMTPLQAAVAVVQKDLRPTIAADTHPVLADLIQRCWQKDPALRPTFAEIVDILNSIKEVVRSSGHHKRHPGRSDSGRRRGC

SEQ ID NO: 4735 - protein, 529 aa, Oryza sativa
MASGAESCGSRGGESPPPPRTRGASAGGRRRKAEAYREVLRRIRGGGGALDDDELWAHFYSLPARYALDVNVERVDDVLLHKRLLDQAREPMNGLVFDVRRSQAATLDGSTEVEQSTSFKHEVQDPQCSSFTSRDQRCFHEIIFACDDKPKLLSQLTALLGELGLNIQEAHAFSTSDGYSLDIFVVDGWSHEVDVLRDALRRGVEKIKYKAWPLVQSMPTRTGHELMEDSPPADFVQIPADATDVWEVDPRLLKFERKLASGSFGDLYHGTYCSQDVAIKVLKPERVSVDMLREFAQEVYIMKKVRHKNVVQFIGACTRPPILCIVTEFMRGGSIFDFLYNFRGTFQLPDVLRIASDVSKGMNYLHQINIVHRDLKTANLLMDDQVVKVADFGVARVKDQSGVMTAETGTYRWMAPEVIEHLPYDQRADVFSFGIVIWELLTGKLPYEDMTPLQAAVAVVQKDLRPIIPADTHPMLAGLLQKCWQKDPALRPTFSEILDILNSIKEAVRSSGHQKRHSGRSYSRQRRSG

SEQ ID NO: 4736 - protein, 530 aa, Brachypodium distachyon
MAAESCGSRGASPPPLHPSSASGGAVGRRRKTEAYREVLRRIRGGAASGGARPGFDDELWAHFHSLPARYALDVNIERVDDVLLHKRLLEEAREPMNGLVFDVRCSQIVTVDGSTEVESSTSIKQEERDPQCSALASSDLRPLHEVIFACDDKPKLLSQLTALLGELGLNIQEAHAFSTSDGYSLDIFVVDGWKYEVDVLRNALSSGIEKIKYRAWPLVHSMPVSMGRQLLEDSSPADCVQIPADATDVWEVDPRLLKFEQKLAAGSFGDLYHGTYCSQDVAIKVLKPERVSVDMLREFAQEVYIMKKVRHKNVVQFIGACTRPPILCIVTEFMRGGSIFDYIYNHRGTFQLVDVLRIASDVSKGMSYLHQINIIHRDLKTANLLMDDKVVKVADFGVARVKDQSGVMTAETGTYRWMAPEVIEHSPYDHRADVFSFGVVLWELLAGKLPYEDMTPLQAAVAVVQKDLRPTIPADTHPMLIGLLQKCWQRDPALRPTFAEILDILQSIKEVVQSSGRHKRRPGPSHSGQR

SEQ ID NO: 4737 - protein, 356 aa, Unknown
  Sequence found in Organisms: Sorghum bicolor, Saccharum officinarum
MGVAGEKFQLGTVGALSLSVVSSVSIVICNKALMSSLGFNFATTLTSWHLLVTFCSLHVALCMKLFEHKPFDARTVMGFGVLNGISIGLLNLSLGFNSVGFYQMTKLAIIPCTVILETLFFRKKFSRNIKLSLSVLLVGVGVATVTDLQLNTVGSVLSLLAIITTCIAQIMTNTIQKKFKVSSTQLLYQSCPYQALTLFLIGPFLDGFLTNQNVFAFDYTTQVLFFIVLSCLISVSVNFSTFLVIGKTSPVTYQVLGHLKTCLVLTFGYVLLHDPFSWRNILGILIAVIGMVLYSYFCTRETQQKPAEVSPQVIQAKEGESNPLISDSLSAAENGGSATDDEPLKVPMWSSKYSKA

SEQ ID NO: 4738 - protein, 356 aa, Setaria italica
MGVAGEKFQLGTVGALSLSVVSSVSIVICNKALMSSLGFNFATTLTSWHLLVTFCSLHVALCMKLFEHKPFDARTVMGFGVLNGISIGLLNLSLGFNSVGFYQMTKLAIIPCTVILETLFFRKKFSRNIKLSLSVLLLGVGVATVTDLQLNTVGSVLSLLAIITTCIAQIMTNTIQKKFKVSSTQLLYQSCPYQALTLFLVGPFLDGFLTNQNVFAFDYTTQVLFFIVLSCLISVSVNFSTFLVIGKTSPVTYQVLGHLKTCLVLTFGYVLLHDPFSWRNILGILIAVIGMVLYSYFCTRETQQKPAEVSPQVIQGKESESNPLISDSLNAAENGGSTPDDEPLKVPMWSSKYSRA

SEQ ID NO: 4739 - protein, 356 aa, Panicum virgatum
MGVAGEKFQLGTVGALSLSVVSSVSIVICNKALMSSLGFNFATTLTSWHLLVTFCSLHVALCMKLFEHKPFDARTVMGFGVLNGISIGLLNLSLGFNSVGFYQMTKLAIIPCTVILETLFFRKKFSRNIKLSLSVLLVGVGVATVTDLQLNAVGSVLSLLAIITTCIAQIMTNTIQKKFKVSSTQLLYQSCPYQALTLFLIGPFLDGFLTNKNVFAFDYTTQVLFFIVLSCLISVSVNFSTFLVIGKTSPVTYQVLGHLKTCLVLTFGYVLLHDPFSWRNILGILIAVIGMVLYSYFCTRETQQKPAEVSPQVIQVKESESNPLISDSLSTAENGGSTTDDEPLKVPMWSSKYSRA

SEQ ID NO: 4740 - protein, 356 aa, Panicum virgatum
MGVAGEKFQLGTVGALSLSVVSSVSIVICNKALMSSLGFNFATTLTSWHLLVTFCSLHVALCMKLFEHKPFDARTVMGFGVLNGISIGLLNLSLGFNSVGFYQMTKLAIIPCTVILETLFFRKKFSRNIKLSLSVLLVGVGVATVTDLQLNAVGSVLSLLAIITTCIAQIMTNTIQKKFKVSSTQLLYQSCPYQALTLFLIGPFLDGFLTNKNVFAFDYTTQVLFFIVLSCLISVSVNFSTFFVIGKTSPVTYQVLGHLKTCLVLTFGYVLLHDPFSWRNILGILIAVIGMVLYSYFCTRETQQKPAEVSPQVIQVKESESNPLISDSLSTAENGGSTTDDEPLKVPMWSSKYSRV

SEQ ID NO: 4741 - protein, 356 aa, Oryza sativa
MGVTGEKFQLGTVGALSLSVVSSVSIVICNKALMSSLGFNFATTLTSWHLLVTFCSLHVALCMKLFEHKPFDARTVMGFGVLNGISIGLLNLSLGFNSVGFYQMTKLAIIPCTVILETLFFRKKFSRNIQLSLSVLLFGVGVATVTDLQLNAVGSVLSLLAIITTCIAQIMTNTIQKKFKVSSTQLLYQSCPYQALTLFIVGPFLDGFLTNQNVFAFDYTSQVVFFIVLSCLISVSVNFSTFLVIGKTSPVTYQVLGHLKTCLVLAFGYVLLHDPFSWRNILGILIAVIGMVSYSYFCTKEAPPKPTEASPQLNQVKESESDPLISDSLSTAENGGNAGDDEALKVPMWSSKYSKA

SEQ ID NO: 4742 - protein, 356 aa, Brachypodium distachyon
MGVGGEKFQLGTVGALSLSVVSSVSIVICNKALMSSLGFIFATTLTSWHLLVTFCSLHVALCMKLFEHKPFDARTVMGFGVLNGISIGLLNLSLGFNSVGFYQMTKLAIIPCTVILETLFFRKKFSRYIQLSLSVLLFGVGVATVTDLQLNAMGSILSLLAIVTTCIAQIMTNTIQKKFKVSSTQLLYQSCPYQALTLFVTGPFLDGFLTNKNVFAFEYTPQVLFFIVLSCLISVSVNFSTFLVIGKTSPVTYQVLGHLKTCLVLAFGYVLLHDPFSWRNILGILIAVIGMGLYSYFCTRETQQKPTDASPQVTQVKEGESDPLISDSLNSAENGGAAADDEPLKVPMWSSKYSRA

SEQ ID NO: 4743 - protein, 356 aa, Unknown
  Sequence found in Organisms: Hordeum vulgare, Secale cereale
MGVAGEKFQLGTVGALSLSVVSSVSIVICNKALMSALGFIFATTLTSWHLLVTFCSLHVALCMKLFEHKPFDARTVMGFGVLNGISIGLLNLSLGFNSVGFYQMTKLAIIPCTVILETLFFRKKFSRYIQLSLSVLLFGVGVATVTDLQLNAMGSVLSLLAIVTTCIAQIMTNTIQKKFKVSSTQLLYQSCPYQALTLFIVGPFLDGFLTNKNVFAFEYTPQVLFFIVLSCLISVSVNFSTFLVIGKTSPVTYQVLGHLKTCLVLAFGYVLLHDPFSWRNILGILIAVVGMGLYSYFCTRETQPKPTEASPQVTQVKEGESDPLIADSLNAAENGAAAATDEPLKVPMWSSKYARA

SEQ ID NO: 4744 - protein, 354 aa, Festuca arundinacea
MGVAGEKFQLGTVGALSLSVVSSVSIVICNKALMSALGFIFATTLTSWHLLVTFCSLHVALCLKFFEHKPFDARTVMGFGVLNGISIGLLNLSLGFNSVGFYQMTKLAIIPCTVILETLFFRKKFSRYIQLSLSVLLFGVGVATVTDLQLNAMGSVLSLLAIVTTCIAQIMTNTIQKKFKVSSTQLLYQSCPYQALTLFVVGPFLDGFLTNKNVFAFDYTPQVLFFIVLSCLISVSVNFSTFLVIGKTSPVTYQVLGHLKTCLVLAFGYVLLHDPFSWRNILGILIAVIGMGLYSYFCTRETKPTEASPQVTQVKEGESDPLISDSLSSAENGAAAADDEPLKVPMWSSKYARA

SEQ ID NO: 4745 - protein, 356 aa, Avena sativa
MGVAGEKFQLGTVGALSLSVVSSVSIVICNKALMSALGFIFATTLTSWHLLVTFCSLHVALWLKFFEHKPFDARTVMGFGVLNGISIGLLNLSLGFNSVGFYQMTKLAIIPCTVILETLFFRKKFSRYIQLSLSVLLFGVGVATVTDLQLNAMGSILSLLAIITTCIAQIMTNTIQKKFKVSSTQLLYQSCPYQALTLFVVGPFLDGFLTNKNVFAFAYTPQVLFFIVLSCLISVSVNFSTFLVIGKTSPVTYQVLGHLKTCLVLAFGYVLLHDPFSWRNILGILIAVIGMGLYSYFCTRETQQKPAEASPQVTQVKEGESDPLISDSLSTAENGAVAATDEPLKVPMWSSKYARA

SEQ ID NO: 4746 - protein, 354 aa, Oryza sativa
MGVGGEKFQLGTVGALSLSVVSSVSIVICNKALMSSLGFNFATTLTSWHLLVTFCSLHVALWMKFFEHKPFDSRTVMGFGVLNGISIGLLNLSLGFNSVGFYQMTKLAIIPCTVILETLFFRKKFSRSIQLSLSVLLFGVGVATVTDLQLNAVGSVLSLLAIITTCIAQIMTNTIQKKFKVSSTQLLYQSCPYQSLTLFLIGPFLDGFLTNQNVFAFDYTSQVVFFIVLSCLISVSVNFSTFLVIGKTSPVTYQVLGHLKTCLVLTFGYVLLHDPFSWRNILGILIAVVGMVLYSYFCTLEGQQKNAEVSPQQAKEGDSAPLISDSLSKVENGGGVVDDEPLKVPMWSSKYSRA

SEQ ID NO: 4747 - protein, 355 aa, Triticum aestivum
MGLAGEKFQLGTVGALSLSVVSSVSIVICNKALMSALGFIFATTLTSWHLLVTFCSLHVALCMKLFEHKPFDARTVMGFGVLNGISIGLLNLSLGFNSVGFYQMTKLAIIPCTVILETLFFRKKFSRYIQLSLSVLLFGVGVATVTDLQLNAMGSVLSLLAIVTTCIAQIMTNTIQKKFKVSSTQLLYQSCPYQALTLFIVGPFLDGFLTNKNVFAFAYTPQVLFFIVLSCLISVSVNFSTFLVIGKTSPVTYQVLGHLKTCLVLAFGYVLLHDPFSWRNILGILIAVVGMGLYSYFCTREAPKPTEASPQVTQVKEGESDPLIADSLNAAENGAAATTDEPLKVPMWSSKYARA

SEQ ID NO: 4748 - protein, 442 aa, Secale cereale
QNAARLHSTSCRPTAGGADPPAPIRSLAPRPLRSPRASLSQIQLPALGFSAKRSCRRRGSVGSSSAAAAAADSCFPCSVCSEGGRRRWGCGGEVPAGDVGALSLSVVSSVSIVICNKALMSALGFIFATTLTSWHLLVTFCSLHVALCMKLFEHKPFDARTVMGFGVLNGISIGLLNLSLGFNSVGFYQMTKLAIIPCTVILETLFFRKKFSRYIQLSLSVLLFGVGVATVTDLQLNAMGSVLSLLAIVTTCIAQIMTNTIQKKFKVSSTQLLYQSCPYQALTLFIVGPFLDGFLTNKNVFAFEYTPQVLFFIVLSCLISVSVNFSTFLVIGKTSPVTYQVLGHLKTCLVLAFGYVLLHDPFSWRNILGILIAVVGMGLYSYFCTRETQPKPTEASPQVTQVKEGESDPLIADSLNAAENGAAAATDEPLKVPMWSSKYARA

SEQ ID NO: 4749 - protein, 354 aa, Sorghum bicolor
MGVGGEKFQLGTVGALSLSVVSSVSIVICNKALMSSLGFNFATTLTSWHLLVTFCSLHVALWMKFFEHKPFDSRTVMGFGVLNGISIGLLNLSLGFNSVGFYQMTKLAIIPCTVILETLFFRKKFSRSIQMSLSVLLLGVGVATVTDLQLNAVGSILSLLAIITTCIAQIMTNTIQKKFKVSSTQLLYQSCPYQSLTLFLIGPFLDGFLTNQNVFAFNYTSQVVFFIVLSCLISVSVNFSTFLVIGKTSPVTYQVLGHLKTCLVLTFGYVLLHDPFSWRNILGILIAVVGMVLYSYFCTVETQQKNTEVSPQQVKESEAAPLISDSLSKAENGGGGVDDEPLKVPMWSSKYSRE

SEQ ID NO: 4750 - protein, 354 aa, Panicum virgatum
MGVGGEKFQLGTVGALSLSVVSSVSIVICNKALMSSLGFNFATTLTSWHLLVTFCSLHVALWMKFFEHKPFDSRTVMGFGVLNGISIGLLNLSLGFNSVGFYQMTKLAIIPCTVILETLFFRKKFSRSIQMSLSVLLLGVGVATVTDLQLNAVGSILSLLAIITTCIAQIMTNTIQKKFKVSSTQLLYQSCPYQSLTLFLIGPFLDGFLTNQNVFAFNYTSQVVFFIVLSCLISVSVNFSTFLVIGKTSPVTYQVLGHLKTCLVLTFGYVLLHDPFSWRNILGILIAVVGMVLYSYFCTVETQQKNAEVSPQQVKESEAVPLISDSLSKVENGGGVADDEPLKVPMWSSKYSRE

SEQ ID NO: 4751 - protein, 354 aa, Setaria italica
MGVGGEKFQLGTVGALSLSVVSSVSIVICNKALMSSLGFNFATTLTSWHLLVTFCSLHVALWMKFFEHKPFDSRTVMGFGVLNGISIGLLNLSLGFNSVGFYQMTKLAIIPCTVILETLFFRKKFSRSIQMSLSVLLLGVGVATVTDLQLNAVGSTLSLLAIITTCIAQIMTNTIQKKFKVSSTQLLYQSCPYQSLTLFLIGPFLDGFLTNQNVFAFNYTSQVVFFIVLSCLISVSVNFSTFLVIGKTSPVTYQVLGHLKTCLVLTFGYVLLHDPFSWRNILGILIAVVGMVLYSYFCTVETQQKNTEVSPQQVKESEAAPLISDSLSKVENGGGVADDEPLKVPMWSSKYSRE

SEQ ID NO: 4752 - protein, 354 aa, Zea mays
MGVGGEKFQLGTVGALSLSVVSSVSIVICNKALMSSLGFNFATTLTSWHLLVTFCSLHVALWMKFFEHKPFDSRTVMGFGVLNGISIGLLNLSLGFNSVGFYQMTKLAIIPCTVILETLFFRKKFSRSIQMSLSVLLLGVGVATVTDLQLNAVGSILSLLAIITTCIAQIMTNTIQKKFKVSSTQLLYQSCPYQSLTLFLIGPFLDGFLTNQNVFAFNYTSQVVFFIVLSCLISVSVNFSTFLVIGKTSPVTYQVLGHLKTCLVLAFGYVLLHDPFSWRNILGILIAVVGMVLYSYFCTVETQQKNVEVSPQQVKESEAGPLIADSMSKVENGGGGVDDEPLKVPMWSSKYSRE

SEQ ID NO: 4753 - protein, 354 aa, Panicum virgatum
MGVGGEKFQLGTVGALSLSVVSSVSIVICNKALMSSLGFNFATTLTSWHLLVTFCSLHVALWMKFFEHKPFDSRTVMGFGVLNGISIGLLNLSLGFNSVGFYQMTKLAIIPCTVILETLFFRKKFSRSIQMSLSVLLLGVGVATVTDLQLNAVGSILSLLAIITTCIAQIMTNTIQKKFKVSSTQLLYQSCPYQSLTLFLIGPFLDCFLTNQNVFAFNYTSQVVFFIVLSCLISVSVNFSTFLVIGKTSPVTYQVLGHLKTCLVLTFGYVLLHDPFSWRNILGILIAVVGMVLYSYFCTVETQQKNAEVSPQQVKESEAVPLISDSLSKVENGGGVADDEPLKVPMWSSKYSRE

SEQ ID NO: 4754 - protein, 349 aa, Pennisetum glaucum
GGEKFQLGTVGALSLSVVSSVSIVICNKALMSSLGFNFATTLTSWHLLVTFCSLHVALWMKFFEHKPFDSRTVMGFGVLNGISIGLLNLSLGFNSVGFYQMTKLAIIPCTVILETLFFRKKFSRSIQMSLSVLLLGVGVATVTDLQLNAVGSILSLLAIITTCIAQIMTNTIQKKFKVSSTQLLYQSCPYQSLTLFLVGPFLDGFLTNQNVFAFNYTSQVVFFIVLSCLISVSVNFSTFLVIGKTSPVTYQVLGHLKTCLVLTFGYVLLHDPFSWRNILGILIAVVGMVLYSYFCTVETQKNTEVSPQQVKESEAAPLISDSLSKVENGGVADDEPLKVPMWSSKYSRE

SEQ ID NO: 4755 - protein, 352 aa, Hordeum vulgare
MGVGGEKFQLGTVGALGLSVVSSVSIVICNKALMSSLGFTFATTLTSWHLLVTFCSLHVALWMKFFEHKAFDSRTVMGFGVLNGISIGLLNLSLGFNSVGFYQMTKLAIIPCTVILETLFFRKKFSRTIQISLSVLLLGVGVATVTDLQLNAVGSILSLLAIITTCIAQIMTNTIQKKFKVSSTQLLYQSCPYQSLTLFLIGPFLDGFLTNQNVFAFNYTSNVVFFIVLSCLISVSVNFSTFLVIGKTSPVTYQVLGHLKTCLVLTFGYVLLHDPFSWRNILGILIAVVGMVLYSYFCSIETQPKNTEVSSQQAKEGDSAPLISDSLSKVENGGDDDEPLKVPMWSSKYSKA

SEQ ID NO: 4756 - protein, 352 aa, Brachypodium distachyon
MGVGGEKFQLGTVGALSLSVVSSVSIVICNKALMSSLGFTFATTLTSWHLLVTFCSLHVALWMKFFEHKAFDSRTVMGFGVLNGISIGLLNLSLGFNSVGFYQMTKLAIIPCTVILETLFFRKKFSRTIQISLSVLLLGVGVATVTDLQLNAVGSILSLLAIITTCIAQIMTNTIQKKFKVSSTQLLYQSCPYQSLTLFLIGPFLDGFLTNQNVFAFNYTSQVVFFIVLSCLISVSVNFSTFLVIGKTSPVTYQVLGHLKTCLVLTFGYVLLHDPFSWRNILGILIAVVGMVLYSYFCSVEAQPKSAEVSTQQAKESDSAPLISDSLSKVENGGDDDEPLKVPMWSSKYSRA

SEQ ID NO: 4757 - protein, 350 aa, Avena sativa
MGVGGEKFQLGTVGALGLSVVSSVSIVICNKALMSSLGFTFATTLTSWHLLVTFCSLHVALWMKFFEHKAFDSRTVMGFGVLNGISIGLLNLSLGFNSVGFYQMTKLAIIPCTVILETLFFRKKFSRTIQISLSVLLLGVGVATVTDLQLNAVGSILSLLAIITTCIAQIMTNTIQKKFKVSSTQLLYQSCPYQSLTLFLIGPFLDGFLTNQNVFAFNYTSQVVFFIVLSCLISVSVNFSTFLVIGKTSPVTYQVLGHLKTCLVLTFGYVLLHDPFSWRNILGILIAVVGMVLYSYFCSIEPKNAEVSPQQTKEGDSAPLISDSLSKVENGGDDDEPLKVPMWSSKYSRA

SEQ ID NO: 4758 - protein, 352 aa, Secale cereale
MGVGGEKFQLGTVGALGLSVVSSVSIVICNKALMSSLGFTFATTLTSWHLLVTFCSLHVALWMKFFEHKAFDSRTVMGFGVLNGISIGLLNLSLGFNSVGFYQMTKLAIIPCTVILETLFFRKKFSRTIQISLSVLLLGVGVATVTDLQLNAVGSILSLLAIITTCIAQIMTNTIQKKFKVSSTQLLYQSCPYQSLTLFLIGPFLDGFLTNQNVFAFNYTSNVVFFIVLSCLISVSVNFSTFLVIGKTSPVTYQVLGHLKTCLVLTFGYVLLHDPFSWRNILGILIAVVGMVLYSYFCSIETQPKNTDASAQQSKEGDSAPLISDSLSKVENGGDDDEPLKVPMWSSKYSRA

SEQ ID NO: 4759 - protein, 355 aa, Secale cereale
MGVRGEKSSWGRGGAEPLLGLLGLHCHLHKALMSALGFIFATTLTSWHLLVTFCSLHVALCMKLFEHKPFDARTVMGFGVLNGISIGLLNLSLGFNSVGFYQMTKLAIIPCTVILETLFFRKKFSRYIQLSLSVLLFGVGVATVTDLQLNAMGSVLSLLAIVTTCIAQIMTNTIQKKFKVSSTQLLYQSCPYQALTLFIVGPFLDGFLTNKNVFAFEYTPQVLFFIVLSCLISVSVNFSTFLVIGKTSPVTYQVLGHLKTCLVLAFGYVLLHDPFSWRNILGILIAVVGMGLYSYFCTRETQPKPTEASPQVTQVKEGESDPLIADSLNAAENGAAAATDEPLKVPMWSSKYARA

SEQ ID NO: 4760 - protein, 315 aa, Panicum virgatum
ATTLTSWHLLVTFCSLHVALCMKLFEHKPFDARTVMGFGVLNGISIGLLNLSLGFNSVGFYQMTKLAIIPCTVILETLFFRKKFSRNIKLSLSVLLVGVCVATVTDLQLNAVGSILSLLAIITTCIAQIMTNTIQKKFKVSSTQLLYQSCPYQALTLFLIGPFLDGFLTNKNVFAFDYTTQVLFFIVLSCLISVSVNFSTFLVIGKTSPVTYQVLGHLKTCLVLTFGYVLLHDPFSWRNILGILIAVIGMVLYSYFCTRETQQKPAEVSPQVIQVKESESNPLISDSLSTAENGGSTTDDEPLKVPMWSSKYSRA

SEQ ID NO: 4761 - protein, 353 aa, Theobroma cacao
MSENRKFQLGTVGALSLSVVSSVSIVICNKALISTLGFTFATTLTSWHLLVTFCSLHVALWMKLFEHKPFDARAVMGFGILNGISIGLLNLSLGFNSVGFYQMTKLAIIPCTVLLETLFFRKRFSRNIQLSLAILLLGVGIATVTDLQLNLLGSVLSLLAVITTCVAQIMTNTIQKKFKVSSTQLLYQSCPYQAITLFIIGPFLDGLLTNQNVFAFKYTPQVLFFIVLSCLISVSVNFSTFLVIGKTSPVTYQVLGHLKTCLVLAFGYVLLRDPFSWRNILGILIAVLGMVLYSYYCTSETQQQKASEASAQLPQVKESESDPLISVENGSGILSDGVGPKAPVWSSNKDLHA

SEQ ID NO: 4762 - protein, 322 aa, Saccharum officinarum
MGVGGEKFQLGTVGALSLSVVSSVSIVICNKALMSSLGFNFATTLTSWHLLVTFCSLHVALWMKFFEHKPFDSRTVMGFGVLNGISIGLLNLSLGFNSVGFYQMTKLAIIPCTVILETLFFRKKFSRSIQMSLSVLLLGVGVATVTDLQLNAVGSILSLLAIITTCIAQIMTNTIQKKFKVSSTQLLYQSCPYQSLTLFLIGPFLDGFLTNQNVFAFNYTSQVVFFIVLSCLISVSVNFSTFLVIGKTSPVTYQVLGHLKTCLVLTFGYVLLHDPFSWRNILGILIAVVGMVLYSYFCTVETQQKNTEVFPQQVKRKPGSPL

SEQ ID NO: 4763 - protein, 351 aa, Euonymus alatus
MSEGQKFQLGTVGALSLSVVSSVSIVICNKALISTLGFTFATTLTSWHLLVTFCSLHVALWMKFFEHKPFDARSVMVFGILNGISIGLLNLSLGFNSVGFYQMTKLAIIPCTVLLETLFFMKKFSRNIQLSLAILLLGVGIATVTDLQLNLLGSILSLLAVITTCIAQIMTNTIQKKFKVSSTQLLYQSSPYQAITLFIVGPFLDGLLTNKNVFAFNYTPQVLFFVVLSCLISVSVNFSTFLVIGKTSPVTYQVLGHLKTCLVLAFGYVLLRDPFSWRNILGIFIAVIGMVLYSYSCTVETQQKASEAPPQAPQAKEGESDPLISVENGSGILADGVATGPVWKSNKDLQA

SEQ ID NO: 4764 - protein, 352 aa, Vitis vinifera
MGESQRFQLGTVGALSLSVVSSVSIVICNKALISSLGFSFATTLTSWHLLVTFCSLHVALWMKLFEHKPFDARAVMGFGILNGTSIGLLNLSLGFNSVGFYQMTKLAIIPCTVLLETLFFRKRFSRSIQLSLSILLLGVGIATVTDLQLNALGSVLSLLAVITTCIAQIMTNNIQKKFKVSSTQLLYQSCPYQAMTLFIAGPFLDWLLTKQNVFAFKYTSEVLVFIVLSCLISVSVNFSTFLVIGKTSPVTYQVLGHLKTCLVLAFGYVLLHDPFSWRNILGILIALIGMVLYSYYCSREGQQKPSEVSAQMAQAKESETDPLIGVENGAGILTDAVVAKVPAWNSNKDLQA

SEQ ID NO: 4765 - protein, 348 aa, Citrus sinensis
MSEGQKFQLGTVGALSLSVISSVSIVICNKALISSLGFTFATTLTSWHLLVTFCSLHVALWMKLFEHKPFDPRAVMGFGVLNGISIGLLNLSLGFNSVGFYQMTKLAIIPCTILLETLFFRKKFSRNIQLSLVILLVGVGIATVTDLQLNVLGSVLSLLAVLTTCVAQIMTNTIQKKFKVSSTQLLYQSCPYQALTLFIIGPFLDGLLTNKNVFAFKYTPYVLFFIVLSCLISVSVNFSTFLVIGKTSPVTYQVLGHLKTCLVLAFGYVLLHDPFSWRNILGILIAVIGMVLYSYCCSLESQQKASETSSQLPQVKEGETDPLINAEKGTGDGVAKAPAWNSNKDLHA

SEQ ID NO: 4766 - protein, 291 aa, Tripterygium wilfordii
MKFFEHKPFDARAVMVFGILNGISIGLLNLSLGFNSVGFYQMTKLAIIPCTVLLETLFFMKKFSRSIQLSLAILLLGVGIATVTDLQLNLLGSILSLLAVITTCVAQIMTNTIQKKFKVSSTQLLYQSSPYQAITLFIVGPFLDGLLTNKNVFAFNYTLQVVFFIVLSCLISVSVNFSTFLVIGKTSPVTYQVLGHLKTCLVLAFGYVLLRDPFSWRNILGILIAVVGMVLYSYYCTVESQQKASEASAQVPQVKEGESDPLLSVENGSGILADGVVAKGPVWKSNKDLEA

SEQ ID NO: 4767 - protein, 350 aa, Euphorbia peplus
MSESQKFQLGTVGALSLSVVSSVSIVICNKALISTLGFTFATTLTSWHLLVTFCSLHVALWMKLFEHKPFDARAVMGFGVLNGISIGLLNLSLGFNSVGFYQMTKLAIIPCTVLLETLFFRKQFSRHIQLSLVILLMGVGIATVTDLQLNVLGSVLSLLAVLTTCVAQIMTNTIQKKFKVSSTQLLYQSCPYQAMTLFVIGPFLDGLLTNQNVFAFKYTPQVLFFIVLSCMISVSVNFSTFLVIGKTSPVTYQVLGHLKTCLVLAFGYVLLRDPFSWRNILGIFIAVIGMVLYSYCCTLETQQKPSETSAKLPEVKESESDPLIGVENGSGIDSGVPKAPVWNSNKDFHA

SEQ ID NO: 4768 - protein, 352 aa, Carica papaya
MSEVQKFQLGTVGALSLSVVSSVSIVICNKALISTLGFTFATTLTSWHLLVTFCSLHLALWMKLFEHKPFDARAVMGFGILNGISIGLLNLSLGFNSVGFYQMTKLAIIPCTVLLETLFFRKKFSRKIQFSLAILLVGVGIATVTDLQLNVLGSVLSLLAVITTCVAQIMTNTIQKKFKVSSTQLLYQSCPYQAITLFITGPFLDGLLTNQNVFAFKYTPQVLFFIVLSCLISVSVNFSTFLVIGKTSPVTYQVLGHLKTCLVLAFGYVLLRDPFSWRNILGILIAVIGMVLYSYYCTKETQQKANEASAQLPQVKESEADPLISVEPGSGMLADGVVPKAPVWNSNKDLHA

SEQ ID NO: 4769 - protein, 352 aa, Amborella trichopoda
MSEGERFQLGTVGALSLSVVSSVSIVICNKALISTLGFTFATTLTSWHLLVTFCSLHVALWMRLFEHKPFDARAVMGFGILNGISIGLLNLSLGFNSVGFYQMTKLAIIPCTVLLETIFFRKKFSRSIQLSLTILLLGVGIATVTDLQLNALGSVLSLLAVVTTCVAQIMTNTIQKRFKVSSTQLLYQSCPYQAMTLFIIGPFLDGLLTNQNVFAFKYTPQVLVFIVLSCLISVSVNFSTFLVIGKTSPVTYQVLGHLKTCLVLAFGYVLLHDPFSWRNILGILIALVGMVLYSYLCTLESQQKASEAAPQLSPAKESETDPLINVENGAGIIVDAVGAKSPVWSSNKDLHA

SEQ ID NO: 4770 - protein, 353 aa, Vitis vinifera
MSENKGFELGTIGALSLSVVSSVSIVICNKALISSLGFTFATTLTSWHLLVTFCSLHVALWMKLFEHKPFDAKAVMGFGILNGISIGLLNLSLGFNSVGFYQMTKLAIIPCTVLLETLFFRKKFSRSIQLALSILLMGVGIATVTDLQLNALGSILSVLAVITTCIAQIMTNTIQKKFKVSSTQLLYQSCPYQALTLFISGPFLDWFLTSQNVFAFKYTPQVLVFIVLSCLISVSVNFSTFLVIGKTSPVTYQVLGHLKTCLVLAFGYVLLHDPFSWRNILGILIALVGMVLYSYYCTREGQQKTSEASAQSSSQAKEGEADPLINIENETGILTDAAVPKAPVWSSNKDLHA

SEQ ID NO: 4771 - protein, 352 aa, Ricinus communis
MSESQRFQLGTVGALSLSVVSSVSIVICNKALISTLGFTFATTLTSWHLLVTFCSLHVALWMKMFEHKPFDARAVMGFGILNGISIGLLNLSLGFNSVGFYQMTKLAIIPCTVLLETLFFRKKFSRNIQFSLTILLLGVGIATVTDLQLNVLGSVLSLLAVVTTCIAQIMTNTIQKKFKVSSTQLLYQSCPYQAITLFIIGPFLDGLLTNLNVFAFKYTPQVLFFIVLSCLISVSVNFSTFLVIGKTSPVTYQVLGHLKTCLVLAFGYVLLRDPFSWRNILGILIAVIGMVLYSYCCTVENQQKASETSVKLPEVKEGESDPLIGVENGSGILADGVVPKAPVWNSNKDLHA

SEQ ID NO: 4772 - protein, 352 aa, Ambrosia trifida
MGEGQGFQLGTVGALSLSVISSVSIVICNKALISTLGFTFATTLTSWHLLVTFCSLHVALWMKFFEHKPFDSRAVMGFGVLNGISIGLLNLSLGFNSVGFYQMTKLAIIPCTVLLETLFFSKQFSKKVKFALTILLLGVGIATVTDLQLNLMGSVLSLFAIITTCVAQIMTNTIQKKFKVSSTQLLYQSCPYQALILFIVGPFLDALLTNQNVFAFKYTPQVLAFIVLSCLISVSVNFSTFLVIGKTSPVTYQVLGHLKTCLVLAFGYVLLHDPFSWRNILGILIAVVGMVLYSYFCTRDAQPKPVETSTQFSQSKESENDPLISAENGLNVSNEGSPPKPPVWSSDKDLHA

SEQ ID NO: 4773 - protein, 353 aa, Unknown
  Sequence found in Organisms: Gossypium hirsutum, Gossypium raimondii
MSENREFQLGTIGALSLSVVSSVSIVICNKALISTLGFTFATTLTSWHLLVTFCSLHVALWMKLFEHKPFDARAVMGFGILNGISIGLLNLSLGFNSVGFYQMTKLAIIPCTVLLETLFFRKKFSRNIQLSLAILLLGVGIATVTDLQLNILGSILSLLAVVTTCIAQIMTNTIQKKFKVSSTQLLYQSCPYQALTLFIIGPFLDGLLTNKNVFAFKYTPQVLFFIVLSCLISVSVNFSTFLVIGKTSPVTYQVLGHLKTCLVLAFGYVLLHDPFSWRNILGILIAVVGMVIYSYYCTVESQQQKASEVSPQLPQVKESESDPLISVDNGSGMLSDGVGPKAPVWNTNKDLHA

SEQ ID NO: 4774 - protein, 272 aa, Fagus grandifolia
MGEGERFQLGTVGALTLSVVSSVSIVICNKALMSSLGFHFATTLTSWHLLVTFCSLHVALKMKFFEHKPFDQRAVMGFGILNGISIGLLNLSLGFNSVGFYQMTKLAIIPCTVVLETLFLAKRFSRTIQLSLIVLLLGVGIATVTDVQLNAMGSVLSLLAIVTTCIAQIMTNTIQKKFKVSSTQLLYQSCPYQAGILLISGPFLDGLLTDQNVFAFKYTTQVLAFIILSCLISVSVNFSYFSCNWKDIPSHLSGSWTPEDLLGAGIRLCLTS

SEQ ID NO: 4775 - protein, 353 aa, Gossypium hirsutum
MSENRKFQLGTIGALSLSVVSSVSIVICNKALISTLGFTFATTLTSWHLLVTFCSLHVALWMKLFEHKPFDARAVMGFGILNGISIGLLNLSLGFNSVGFYQMTKLAIIPCTVLLETLFFRKKFSRNIQFSLAILLLGVGIATVTDMQLNILGSILSLLAVVTTCIAQIMTNTIQKKFKVSSTQLLYQSCPYQALTLFIIGPFLDGLLTNKNVFAFKYTPQVLFFIVLSCLISVSVNFSTFLVIGKTSPVTYQVLGHLKTCLVLAFGYVLLHDPFSWRNILGILIAVVGMVIYSYYCTVESQQQKASEVSPQLPQVKESESDPLISVDNGSGMLSDGVGPKAPVWNTNKDLHA

SEQ ID NO: 4776 - protein, 352 aa, Castanea mollissima
MGEGERFQLGTVGALSLSVVSSVSIVICNKALMSSLGFHFATTLTSWHLLVTFCSLHVALKMKFFEHKPFDQTAVMGFGILNGISIGLLNLSLGFNSVGFYQMTKLAIIPCTVVLETLFLGKKFSRTIQLALIILLLGVGIATVTDVQLNALGSILSLLAIVTTCVAQIMTNTIQKKFKVSSTQLLYQSCPYQAGTLLISGPFLDGLLTDQNVFAFKYTNQVLAFIILSCLISVSVNFSTFLVIGKTSPVTYQVLGHLKTCLVLAFGYVLLHDPFNWRNILGILIALIGMVLYSYFCTRESQQKANETAAQPFQVVEGESDPLLNAENGKGGLTDAVVPKAPVWNSNKDLHA

SEQ ID NO: 4777 - protein, 352 aa, Eucalyptus grandis
MSENKGFQLGTIGALSLSVVSSVSIVICNKALISTLGFTFATTLTSWHLLVTFCSLHVALCMKLFEHKPFDARAVMGFGILNGISIGLLNLSLGFNSVGFYQMTKLAIIPCTVLLETLFFRKLFSRSVQFSLIILLIGVGIATVTDLQLNVLGSVLSLLAVLTTCVAQIMTNTIQKKFKVSSTQLLYQSCPYQAITLFVTGPFLDGMLTNKNVFAFKYTPQVLFFIVLSCLISVSVNFSTFLVIGKTSPVTYQVLGHLKTCLVLAFGYVLLHDPFSWRNILGILIAVVGMVLYSYYCTVETQQKANEASAQLTQPKESETDPLIGVENGSAILSDGVVTKGPVWNSNKDLHA

SEQ ID NO: 4778 - protein, 360 aa, Amsonia hubrichtii
MSDGQRFQLGTIGALSLSVVSSVSIVICNKALISTLGFTFATTLTSWHLLVTFCSLHVALWMKLFEHKPFDPRAVMGFGILNGTSIGLLNLSLGFNSVGFYQMTKLAIIPCTVLLETLFFRKKFSRNIQGSLGVLLLGVGIATVTDLQLNVVGSVLSLLALVTTCIAQIMTNTIQKKFKVSSTQLLYQSCPYQAITLFITGPFVDGLLTNQNVFAFKYTPQVLAFIVLSCLISVSVNFSTFLVIGKTSPVTYQVLGHLKTCLVLAFGYVLLRDPFSWRNILGILIAVVGMVLYSYYCTLEGQQKASEVAAAQLAQAKESESDPLLGVENGGGILTDGVAKALDGIQTRTCTHNHPSVIIN

SEQ ID NO: 4779 - protein, 101 aa, Zea mays
MPDGECVTAVGSTARPARHISRSWYHPSRLLPPDTYLPPLVHCTYSTPSCSQSCVRCNQACRCRHARSSRQLSTQHGLRRCRVHQQSHPQHRLRLAPLGSL

SEQ ID NO: 4780 - protein, 150 aa, Saccharum officinarum
MNIQRKPGDWNCKNCQHLNFSRRDYCQRCRDPRPDLQFGDGYSTGGVLTSLDIRPGDWYCSCGYHNFASRSSCFKCGTIVRDFPAGQGAAGGEGDLARGRDSAAFVLGGKLATGSAQGLVATCTTLLVGWSAIGAMDQGRQAPGSKRRPR

SEQ ID NO: 4781 - protein, 145 aa, Panicum virgatum
MNIQRKPGDWNCKNCQHLNFSRRDYCQRCRDPRPDLQFSDGYSTGGVLTSLDIRPGDWYCSCGYHNFASRSSCFKCGTIVRDFPAGQGAAGAEGDLARGRDSAAVRAGWKAGDWICTRPGCNVHNFASRTECYRCNAPRETGTNV

SEQ ID NO: 4782 - protein, 151 aa, Sorghum bicolor
MNIQRKPGDWNCKNCQHLNFSRRDYCQRCRDPRPDLQFSDSYSTGGVLTSLDIRPGDWYCSCGYHNFASRSSCFKCGTIVRDFPAGQGAAGAEVDFARGRDSAAVRAGWKAGDWICISVLWPGLVATCTTLLAGWSAIGAMDQGRQVYVGK

SEQ ID NO: 4783 - protein, 145 aa, Oryza sativa
MNIQRKPGDWNCKSCQHLNFSRRDYCQRCHTPRQDLPLGDGYVPGGVLTSLDIRPGDWYCNCGYHNFASRASCFKCGAIVKDLPAGQGGGVANGDFARALDSSAVRAGWKAGDWICTRPGCNVHNFASRIECYRCNAPREAGNVK

SEQ ID NO: 4784 - protein, 265 aa, Sorghum bicolor
MDVLKRELQRKRQLLNADFGGRRVLRRAEIEARELQRIREAERQLLLQKQLRHSRLAAVSSPSSSSSSPTSAPADADASRAESGSEESLPREEVIRRLRVLRQPATLFGEDDVARLRRLRDLIEDPAALADVDEAEIGEGQTNDFLRDIQALRAKAAAATKPKAAGVEAQRGEGDDGVPGDVPFEELCDEDKITAFFRRLMGEWTQEVDGMPEAERRTAKGKAAVATCKQCARYLDPLFKQCKKKEGIILNAQTQPSTIRLQLVP

SEQ ID NO: 4785 - protein, 375 aa, Setaria italica
MDVLKRELQRKRQLLDADFGARKILRRAEIEARELQRIREAERRRLLQKQLRDSHPAASSPPGTYSGSSPASAAADAPPAENGASGQTESLPRDEVIRRLRVLRQPATLFGEDDAARLRRLNDVLEDPTALADVDADEIGEGQTNDFLRDIQALRVKAAAATKPKAGAEAQRREGDGEEREVPFEELCDEDKIAAFFRRLMGEWSQEMDEMPEAERRTAKGKAAVATCKQCARYLDPLFKQCKKKALPPDVRQALLEVVKCCMRRDYLAAVDNYIKLAIGNSPWPIGVTMVGIHERSAREKIYTNSVAHIMNDETTRKYLQSVKRLITFCQRKYPTDPSRSVEFNSLANGSDLQSLLAEQNAKNSEETLQLVAAS

SEQ ID NO: 4786 - protein, 407 aa, Sorghum bicolor
MAKGRAHHSKRPTHQLLLAAVLSVSVLLPLFVPAAATVAVAEGDGVSALGGGKPLAVGKDEGKLVAEGDAGGGGSVEEDEFAGGFGSLDSMLQWAIGNSDPEKLKEEAADAQKLSEDELLKRRQEIKELMEKLKMPSDADLMKIAIDDLNNSSISLEDRQRALQELLVLVEPIDNANDLDKLGGLLPVIQELSNANEEIRTTSAWVLGTASQNNELVQNQILGYGALARLVKMGYSTSAEEAAKALYAISSLIRNNVNGQEAFHSENGSAMLQHILVSNNIDVRLQKKVVFLVTDLADFQLNSGIVQLPFLSERLFLKSIMDMLSRFDLDLQEKVLLAIKNLLKLSSTDVEDFEFCDLSNVLLRLGVQLEDLTPEDQKEFAVEVDALRREVQTLFQQKLKQGKATVA

SEQ ID NO: 4787 - protein, 407 aa, Setaria italica
MAKARAHSSKRPTPHLLLAVSLSVSVLLPLLLPAAVAVAEGDGEIKSALGAGRQWATGKDKGELVAEGDTAGGGSVEEDEFAGGFGSLDSMLQWAIGNSDPEKLKEEAADVQKLSADELLKRRQEIKELMEKLKMPSDADLMKIAIADLKNSSISLEDRQRALQELLVLVEPIDNANDLDKLGGLLPVIQELNNANEEIRTTSAWVLGTASQNNAHVQNQILGYGALARLVKMGYSTSSEEAAKALYAISALIRNNVNGQEAFRSENGSAMLQHILVSNSIDVRLQKKAVFLVTDLADFQLNSGNPQLPFLSDRLFLKSIIDMLSRFDLDLHEKVLLAIKSLLKLSSTDADDFEFYDLGGVLLRLGVQLEDLTPEDQKEFAGEVDALRREVEALFQQKLKQGKASAT

SEQ ID NO: 4788 - protein, 705 aa, Trigonella foenum-graecum
RLKVQQLSDGTRSPVTVRHPKRISNSILNGEGEGEEDGDVVTGSSGHSHEIDNEIVSTDISSCSSGGSENWVLLSISGDKPAPRFNHAAAVIGNKIIVVGGESATGLLDDVQVLNFDTFSWTMASSKLYLSPSSLPLKIPACKGHCLVSYGKKALLIGGKTDPGSDRISVWAFDTESECWSLMEAKGDIPVARNGHSVVRASSYLILFGGEDAKRRKLNDLHMFDLKSLTWLPLHYTGTAPSPRLNHVAALYDDKVLYIFGGSSKSKTLNDLYSLDFETMAWSRVKVRGFHPSPRAGCCGILCGTKWYITGGGSKKKRHGETLIFDTVKNEWSVTITSPPSSITTNKGFSLVLVQYKEKDYLVAFGGSKKEPSNQVEVLELDKNESALRRRSTPSKGPASILLEKHSSSTRLASQLNHCSQRLVDSVARQNLASAVEHGSGRKSLSESVDPHYPPTNVSLRKQFDRDEEYNADVKMDKNSDGSSLPQAADHRTNENGRGKLMNISGAKVNIEGQVLLSGISSQQNQVFENDALESDVSFPENDKSGSLSSTNIYQYYESKVAALIRKNGVLEGQLAASMASREVAEKNLASVHKNRQEMEKKLADALKEMELLREKLAGLELAQEEANNLSNIVHSDNVRLEHDVAFLKAVLDDTQKELHSTRGVIAGERARAFQLQYEVFHLKQRLQSMENRTSTTPRKPFHVQ

SEQ ID NO: 4789 - protein, 708 aa, Glycine max
MFGFSRRRMKLGRLKVQLSEANPGTRTPVRPPKRNGTEIGDAAGGSSGHSDEVDCQPSTEITSCGSSENWMVLSIAGDKPIPRSNHAAAVIGNKMIVVGGESGTGLLDDVQVLNFDRFSWTTASSKLYLSPSSLPLKIPACKGHSLVSWGKKALLIGGKTDPGSDRISVWAFDTETECWSLMEAKGDIPVARSGHSVVRASSVLILFGGEDAKRRKLNDLHMFDLKSLTWLPLHYTGTAPSPRFNHVAALYDDKILYIFGGSSKSRTLNDLYSLDFETMAWSRVKMRGFHPSPRAGCCGVLCGTKWYITGGGSRKKRHGETVIFDIVKNEWSVAITSPPSSITTNKGFSMVLVQHKEKDFLVAFGGSKKEPSNQVEVLIMEKNESALGRQSAPSKCSASVLLEKHSSSTRLAPQLNDCSQRLVDSVARQNLASAIEHGSGRRSLSESLVVDPNFPPTNTSLRKQFDHDEEYNTDLKMDKNSDENSFPRAVDHRTNENDHGKQMNSSGAKNITEEQQALLSGIPIQQNLVFENDMLESDNVSFTENIKSGSLTTSNVYHCYESKLASLIRKNGILEGQLAASLASKEAAEKSLASVLKSRQEMERKLAESHKEMELMREKLTSLELAQEEANNLSNIVHSDNVRLEHDVAFLKAVLDDTQKELHSTRGVIAGERARAFQLQYEVFHLKQRLQSMENRASTTPRKPFHVQ

SEQ ID NO: 4790 - protein, 709 aa, Phaseolus vulgaris
MFGFSRRRMKLGRLKVQLSEANQGTRTPIRHPKRNGNSNGEGDAGSSGHSDEVDCLPSTEISSCASGSSENWMVLSIAGDKPTPRSNHAAAVIGNKMVVVGGESGTGLLDDVQVLNFDRFSWTKASSKLYLSPSSLPLKIPACKGHSLVSWGKKALLIGGKTDPGSDRISVWALDTETECWSLMEAKGDIPVARSGHSVVRAGTVLILFGGEDAKRRKLNDLHMFDLKSFTWLPLHYTGTAPSPRFNHVAALYDDKILYIFGGSSKSRTLNDLYSLDFETMAWSRVKIRGFHPSPRAGCCGVLCGTKWYITGGGSRKKRHGETVIFDIVKNEWSVAITSPPSSISTNKGFSMVLVQHKEKDFLVAFGGSKKEASNQVEVLIMEKNESAVGRQSAPGKCSASVLLEKHSSSARFASQLKDCSQNLVDSVARQNLASAIEHGSGRRSLSESLVVDPNFPPTNTSLRKQFDHDEEYNTDLKMDKNSDESSFPRSGDHRTNENHHGKQMNTCGTKTNIEEQAMLSGIPNQQNLVFENEMPESDNLSFSENNKSASLSSSNVYHYYESKVASLIRKNGILEGQLAASLASKEAAEKSLTSVLKSRQEMERKLADAHKEMELMREKLASLELAQEEANNLSNIVHSDNVRLEHDVAFLKAVLDDTQKELHSTRGVIAGERARAFQLQYEVFHLKQRLQSMENRASTTPRKPFHVQ

SEQ ID NO: 4791 - protein, 715 aa, Glycine max
MFGISRRRMKLGRLKVQLSEANPGTRTPIRHPKRNGNSNGEGEGDAGGSSGHSDEVDCQPSTEITSGSSENWMVLSIAGDKPTPRSNHAAAVIGNKMIVVGGESGTGLLDDVQVLTFDRFSWTMASSKLYLSPSSLPLKIPACKGHSLVSWGKKALLIGGKTDPGSDRISVWAFDTETECWSLMEAKGDIPVARSGHSVVRASSVLILFGGEDAKRRKLNDLHMFDLKSLTWLPLHYTGTAPSPRFNHVAALYDDKILYIFGGSSKSRTLNDLYSLDFETMAWSRVKIRGFHPSPRAGCCDVLCGTKWYITGGGSRKKRHGETVIFDIVKNEWSVAITSPPSSITTNKGFSMVLVQHKEKDFLVAFGGSKKEPSNQVEVLIMEKNESTLGSQSAHSKCSASVLLEKHSSSTRLAPQLNDCSQHLVDSVARQNLASAIEHGSGRRSLSESLVIDPNFPPTNTSLRKQFDHDEEYNTDLKMDKNSDERSFPRAVDHRTNKDYHGKQMNTSEVKTNMEEQQTLLSGILNQQNLVFENDMPESDNLLFSENINININSGSLTTSNVYYYYESKLASLIRKNGILEGQLAASIASKEAAEKSLTSVLKSRQEMDRKLTESEKEMELMREKLAGLELAQEETNNLSNIVHSDNVRLEHDVAFLKAVLDDTQKELHSTRGVIAGERARAFQLQFEVFHLKQRLQSMEKNRASTTPRKPFHVQ

SEQ ID NO: 4792 - protein, 708 aa, Zea mays
MASRVKEDERHEKILRGLLKLPANKRCINCNNLGPQYACTNFWTFVCTNCSGAHREFTHRVKSVSMAKFTAQEVTALQEGGNERAREVFFKEWDPQRNGYPDSSNADKLRNFIKHVYVERRYTGERSTDKPPRAKDDKDEYSENRRSDGNWGGSRSPPDGSYSDRRSYSGRSDDRNSRYSYGDRSPGYDQNDYKKSPRYFEVVDDRSGKTTPVQRFEDRWSSEPRKPDSGSPDFQKEADGSSPVVRPVRDILGDNTPQLRVGEPSKPATEPPKPSVVRPIDPPKPSVVRPIGPPKPNGTRAIDPPPLTKTISSASSIGSSEGTSEQTKVASAVSLIDFSADPEPASTAPPQPTPMPQQPPFNAAAPQPILEQGKSDPSVSGGDWASFDSFGQQQTPQTSSSVNPLESALAQLSFSEAPSAPNASAYPVSLDPTLKANDGGHSSVLDQSHSLFDAPFGISGNQASTVMSGQGSSVQQSPLAAPTAGPPSQATANPQGTSGIQGAASSTDSKFSSRKELPVDIFTALYPPSTQMMPGWQRAPHFGMGYAMQYPPGVGLQSYLHGAFPQPTYQQPVYSQHAYSHPQPVKASNPFDLGNESAHIQAHMPPSGPPGASAGSAPQTLIGNSSFGVPPQQPHQLYQSEAHLSHFMMQQVPNSMPMPEQQPNSMLATQQGLGSFNMGFDQEAPLGYPQANTSPSYGSVGGGSNPFG

SEQ ID NO: 4793 - protein, 692 aa, Zea mays
MASRIKEDERHEKIIRGLLKLPANKRCINCNNLGPQYVCTNFWTFVCTNCSGSHREFTHRVKSVSMAKFTAQEVAALQEGGNERAREVFFKEWDPQRNGYPDSSNADKLRNFIKHVYVERRYTGERSTDRPPRAKDDKDEYSENRRSDGNWGGSRSPPNGSYSDRQNYSGRSDDRNSRYSYGDRSPGYDQNDYKRSPRYFEVGDNRSGKITPIQGFEDRRFSEPRKRDSGSPDFQKEADGSSPVVRPVRDILGDNAPQLRVGEPSKPATEPAKPTVVRPIDPPKPSVVRPIDPPKPNGTRAIDPPPLTKTISSASSIGSAEGTSEQTKVASAVSLIDFSADPEPESTAPPQPAPMTQQPPVNAVAPQPVLEQRKSAPSVSGGDWASFDAFGQQQTPQTSSSVNPLESALAQLSFSEAPSAPNVSAYPVSLDPTLKANDGGYSSVLDQSHSLFDAPFGISGNQASTVMSGQETSVQQSSIAAPTAGLPSQATANQQGTSGIQGAASSTDSKFSGRKELPADIFTALYPPSTPMMPGWQRAPHFGMGYAMQYPPGVFQGMQAYPQPTYQQPVYSQHAYSHPQPVKASNPFDLGNGPAPTQAHMPPSGPPGVLAGPAPQTLISNSSFGVPPQQPHQLYQSAAHPSHFMMQQVPNSMPMPEQQPNSMLVTQQGLGYLQPNTPPPSYGSVGGSNPFG

SEQ ID NO: 4794 - protein, 717 aa, Setaria italica
MASRVKEDERHERIIRGLLKLPANKRCINCNNLGPQYVCTNFWTFICTNCSGAHREFTHRVKSVSMAKFTAQEVTALQEGGNERAREVFFKEWDPQRNGYPDSSNADKLRNFIKHAYVERRFTGERSADRPPRGKDDKDEYSENRRSDGNWGGSRSPPNGSYSDRRSYSGRSDDRNSRYSYGDRSPGYDQNDYKKSPRYFEVVDDRSGKTTPVQRFEDRRFSEPRKPDSGSPDFQKEADGSGPVVRPVRDILGDNAPQLRVGEPSKPATEPPKPIVARPIDPPKPIVARPIDPPKPNGTRAIDPPPLAKTMSSASSIASSEGTSEPVKVANAVSLIDFSADPEPTAPAPPPQPASTTQQHPVNAPAPQPVLDKGNSAPSVSGGDWASFDAFGQQQTPQTTSSANPLESALAQLSFSEAPSATNVSAFPASNDPTLKVNDGGHPSIVDQSHNLFDAPFGISGNQASTVMSNQGSSVQQSPLAAPTAGLPSQVTANPQGTSGIQGAASSNDSKSSGRKELPADIFTALYPTSTPMMPGWQRAPQFGMGYGMQYPAGVFQGMQAYPQAAFPQPTYQQPVYPQHAYPQPQPQPQPQPQPQPVKASNPFDLVNDPVPIQAPMPLSGPLGASAGTTPQTLLGTSSFGVPPQQTHQLYQSAAPPSHFMMQQVPNSMPQQPPNSMHAAQQGLGSFNMGFDQQAPPRYPQPSTPPYGSVGGSNPFG

SEQ ID NO: 4795 - protein, 709 aa, Pennisetum glaucum
MASRVKEDERHERIIRGLLKLPANKRCINCNNLGPQYVCTNFWTFICTNCSGAHREFTHRVKSVSMAKFTAQEVTALQEGGNERAREVFFKEWDPQRNGYPDSSNADKLRNFIKHAYVERRFTGERSADKPPRGKDDRDEYSENRRSDGNWGGSRSPPNGSYSDRRSYSGRSDDRNSRYSYGDRSPGYDQNDYKKSPRYFEVVDDRSGKTTPVQRFEDRRFSEPSKPDNGSPDFQKEADGSSPVVRPVRDILGDNAPQLRVGEPSKPVTEPPKPIVARPIDPPKPIVARPIDPPKPNGTRAIDPPRLAKTMSSASSIASSEGTSEPAKVANAVSLIDFSADPEPAAPLQPASTTQQHPVNAPAPQPVLDQGNSAPSVSGGDWASFDAFGQQQPPQTSGNANPLEVALAQLSFSEAPSATNVSAFPASNDPTSKRNDGGHSSIVDQSHNLFDAPFGISGNQASTVMSNQGSSVQQSPFAAPTAGLPTQVTANPQGTSGIQGATSSNDSKSSGRKELPADIFTALYPTSTPMMPGWQRAPQFGMGYGMQYPAGVFQGIQAYPQAAFAQPTYQQPVYPQHGYPQPQPQPQPQPVKSSNPFDLGNEPVQAHMPLSGPPGASAGTTSQTLLGTSSFGVPPQQPHQLYQSAAPPSHFMIQQVPNSMPQQPPNSMHAMQQGLGSFNMGFDQQAPPRYPQPSTPPSYGSVGGSNPFG

SEQ ID NO: 4796 - protein, 723 aa, Panicum virgatum
MGSRVKEDERHERIIRGLLKLPANKRCINCNNLGPQYVCTNFWTFVCTNCSGAHREFTHRVKSVSMAKFTAQEVTALQEGGNERAREVFFKEWDPQRNGYPDSSNADKLRNFIKHVYVERRYTGERSTDRPPRGKDDKDEYSENRRSDGNWGGSRSPPNGSYSDRQSYSGRSDDRNSRYSYGDRSPGYDQNDYKKSPRYFEGADDSRSVKTTPVQRFEDRRFSEPRKRDSGSPDFQKEADGSSPVVRPVRDILGDNAPQLRVGEPSKPAAEPRKPIVARPIDPPKTAVARPIDPPKPTVTRTIDPPKPNGTRAIDPPPLAKTMSSASSIASSEGISEPTKVANAVSLIDFSADPEPPAPAAPPQPASTTQPHPVNAMAPQPVHEQGKSPVSGGDWASFDAFGQQQTPQTSSSANSLESALAQMSFSEAPAARNVSAFPASIDPTLKANGGHPSIVDQSHNLFDAPFGISGNQASTVMSNQGSSVQQSPLTAPTAGLPSQVTANQQGTSGIQGATFSTDSKSSGRKELPADIFAALYSTSTPMMPGWQRAPQFGMGYGMQYPARVFQGMQGYPQAAFPQPTYQQPVYPQHAYPQTQPQPQPQPVKASNPFDLGNEPAPIQAHMPLSGPPGASAGTTPQTLLGTSSFGVPPQQPHHLYQSAAPPSPFMMQQVPNSMPQQPPNSMHAMQQGLGSFNMGFDQQAPPRYPQPGTPPSYGSVAGSNPFG

SEQ ID NO: 4797 - protein, 699 aa, Panicum virgatum
MLSGQVDIGPQYVCTNFWTFVCTNCSGAHREFTHRVKSVSMAKFTAQEVTALQEGGNERAREVFFKEWDPQRNGYPDSSNADKLRNFIKHVYVERRYTGERITDRPPRGKDDKDEYSENRRSDGNWGGSRSPPNGSYSDRRSYSGRSDERNSRYSYGDRSPGCDQNDYKKSPRYFEGADDRSGKTTPVQRFEDRRFSEPRKPDSGSPDFQKEADGSSPVVRPVRDILGDNAPQLRVGEPSKTAAEPPKPIVARPIDPPKPTARAIDPPKPTVARPIDPPKPNGTRAIDPPPLAKTMSSASSIASSEGISEPVKVANAVSLIDFSADPEPPAPAAPPQPASMTQQHPVNAMAPQPVHEQGKSPVSGGDWASFDAFGQQQTPQTSSSANPLESALAQLSFSEAPSARNVSAFPASVDPTLKVNDGGHSSIVDQSHNLFDAPFGISGNQASTVMSNQGSSVQQSPLTAPTAGLPSQVTANQQGTSGIQGAASSTDSKSSGRKELPADIFAALYPTSTPMMPGWQRAPQFGMGYGMQYPAGVFQGMQGYPRAAFPQPTYQQPVYPQHAYPQPQPQPQPQPQPVKASNPFDLGNEPASIQAHMPLSGPPGASAGTTPQTILGTSSFGVPPQQPHQLYQSAAPPSPFMMQQVPNSMPQQPPNSMHAMQQGLGSFNMGFDQQVPPRYPQPGTPPSYGSVAGSNPFG

SEQ ID NO: 4798 - protein, 422 aa, Sorghum bicolor
MGKHEFLTPKAIANRIKAKGLQKLRWYCQMCQKQCRDENGFKCHCMSESHQRQMQVFGMAPDRVVEGFSEEFLESFLSLIRRAHRHSRVAATVVYNEYIADRHHVHMNSTRWATLTEFVKFLGREGYCKVEDTPKGWFMTYIDRDSEKAVKDRLKRKRIKSDMAEDERQERMIARQIERAHKSLAKPDDGDAAEGEPESGSEEEYSGSDDDGEEREDGSKEASKATGKIAIALQKAVPGPKVNPFEDKPKVKFGFDEDDTGTGEKKDEAAKNKGKDVKATEARRSALDDLMKEEEKAKERSNRKDYWLCPGIVVKVMSKTLAEKGYYKQKGVVKKVIDKYVGEIEMLESKHVLRVDQDELETVIPQIGGLVRIVNGAYRGSNARLLSVDTAKFSAKVQVEKGLYDGKVLRAVEYEDICKISS

SEQ ID NO: 4799 - protein, 427 aa, Setaria italica
MGKSDFLTPKAIANRIKAKGLQKLRWYCQMCQKQCRDENGFKCHCMSESHQRQMQVFGMAPERVVEGFSEEFLETFLALIRRAHRHSRVAATVVYNEYIADRHHVHMNSTRWATLTEFVKFLGREGYCKVEDTPKGWFMTYIDRDSEQAVKARLKRKRIKSDMAEDERQERMIARQIERAQKSLAKANDGDEGNVAEGESESESGSEEDYSGSDDDGEEREDDSKEANKATGKIAIALQKSVPGPKVNPFEDKPKVNFGFDEEDSGVREKKDEVDKKKGKDVKAAEARRSALDELMKEEEKAKERSNRKDYWLCPGIVVKVMSKSLAEKGYYKQKGVVKKVIDKYVGEIEMLESKHVLRVDQDELETVIPQIGGLVRIVNGAYRGSKARLLSVDTEKFCAKVQVEKGLYDGKILRAVEYEDICKISS

SEQ ID NO: 4800 - protein, 427 aa, Pennisetum glaucum
MGKSDFLTPKAIANRIKAKGLQKLRWYCQMCQKQCRDENGFKCHCMSESHQRQMQVFGMAPERVVEGFSEEFLETFLALIRRAHRHSRVAATVVYNEYIADRHHVHMNSTRWATLTEFVKFLGREGYCKVEDTPKGWFMTYIDRDSEQAVKARLKRKRIKSDMAEDERQERMIARQIERAQKSLAKANDGDEGNVAEGESESESGSEEDYSGSDDDGEEQEDGPKEANKATGKIAIALQKSAPGPKVNPFEDKPKVNFGFDEEDSGVREKKDEVDKKKGKDVKAAEARRSALDELMKEEEKAKERSNRKDYWLCPGIVVKVMSKSLAEKGYYKQKGVVKKVIDKYVGEIEMLESKHVLRVDQDELETVIPQIGGLVRIVNGAYRGSNARLLSVDTEKFCAKVQVEKGLYDGKVLRAVEYEDICKISS

SEQ ID NO: 4801 - protein, 1280 aa, Zea mays
MDSIDADLARTQEERRRMEEALAAGAPMAVSSVTFDTDLYGGGGADPNRFAGYDTSIPASEDDAAEDDAEAANPAPRRLAAYTGHAIAAADIPRSADDDDGLPKRSQRIIDREDDYRRRRLNQIISPERHDPFAAGEATPDPSVRTYADVMRDAALQKKKEDLLREIAKKKKEEEEKEKERKAAAPEQPAATTKRRNRWDQSQDGDAGAGAKKVKTSSDWDAPDATPGIGRWDATPGRVGDATPSVRRNRWDETPTPGRMADADATPAAGGATPGATPSGAWDATPKLPGGVTPTPGKKQRSRWDETPASMGSATPGSLGAATPAGYTPGPTPFGAENLATPTPSQIARGPITPEQYQLMRWERDIEERNRPLTDEELDAMFPQEGYKILEPPASYQPIRTPARKLLATPTPLGTPLYAIPEENRGQHFDVPKELPGGLPLMKPEDYQYFGTLLNEEEEEQLSPEEQKERKIMKLLLKVKNGTPPQRKTALRQLTDKAREFGAGPLFNKILPLLMQPTLEDQERHLLVKVIDRVLYKLDELVRPFVHKILVVIEPLLIDEDYYARVEGREIISNLSKAAGLATMIAAMRPDIDNIDEYVRNTTARAFSVVASALGIPALLPFLKAVCQSKKSWQARHTGIKIVQQIAILMGCAVLPHLKSLVEIIEHGLSDENQKVRTITALSLAALAEAAAPYGIESFDTVLKPLWKGIRSHRGKVLAAFLKAIGFIIPLMDALYASYYTKEVMQVLIREFQSPDEEMKKIVLKVVKQCVSTEGVEADYIRNDILPDFFKHFWVRRMALDRRNYKQLVETTVEMANKVGVADIVGRVVEDLKDESEPYRRMVMETIEKVVANLGASDIDARLEELLIDGILYAFQEQTSDDANVMLNGFGAVVNALGQRVKPYLPQICGTIKWRLNNKSAKVRQQAADLISRIAIVMKQCQEEQLMGHLGVVLYEYLGEEYPEVLGSILGALKAIVNVIGMTKMTPPIKDLLPRLTPILKNRHEKVQENCIDLVGRIADRGAEFVPAREWMRICFELLEMLKAHKKGIRRATVNTFGYIAKAIGPQDVLATLLNNLKVQERQNRVCTTVAIAIVAETCSPFTVLPALMNEYRVPELNVQNGVLKSLSFLFEYIGEMGKDYIYAVTPLLEDALMDRDLVHRQTAASAVKHMALGVAGLGCEDALVHLLNYVWPNIFETSPHVINAVMEAIEGMRVALGAAVILNYCLQGLFHPARKVREVYWKIYNSLYIGAQDALVASYPALEDDGDNIFSRPELAMFV

SEQ ID NO: 4802 - protein, 423 aa, Zea mays
MGKHEFLTPKAIANRIKAKGLQKLRWYCQMCQKQCRDENGFKCHCMSESHQRQMQVFGMAPDRVVEGFSEEFLESFLSLIRRAHRHSRVAATVVYNEYIADRHHVHMNSTRWATLTEFVKLLGREGYCKVEDTPKGWFMTYIDRDSEQAVKDRLKRKRIKSDMAEDERQERMIARQIERAHKSLAKPNDGDAAEGEPESGGEEEYSGSDDDGEELEDVSKEANKATGKIAIALQTAVRGPKVNPFEDKPEVKFRFDEEGDLGTGEEKDELAKKKGKDVKAADARRSALDELMKEEEMAKERSNRKDYWLCPGIVVKVMSKSLAEKGYYKQKGVVRKVMDKYVGEIEMLESKHVLRVDQDELETVIPQIGGLVRILNGAYRGSNARLLSVDTEKFCAKVQVEKGLYDGKVLRAVKYEDICKISS

SEQ ID NO: 4803 - protein, 428 aa, Panicum virgatum
MGKHEFLTPKAIANRIKAKGLQKLRWYCQMCQKQCRDENGFKCHCMSESHQRQMQVFGMAPERVVEGFSEEFLELFLALIRRAHRHSRVAATVVYNEYIADRHHVHMNSTRWATLTEFVKFLGREGYCKVEDTPKGWFMTYIDRDSEQAVKARLKRKRIKSDMAEDERQERMIARQIERAQKSLAKANDGDDGNVAEGESESEYDSEEEYSGSDDGGEKLEDGSKEANKATGKIAIALQKSAPGPKVNPFEDKPKVNFGFDEEDSGVREKEKDEVANKKGKDVKAAEPRRSALDELMKEEEKAKEKSNRKDYWLCPGIVVKVMSKSLAPRGYYKQKGVVKKVIDKYVGEIEMLESKHVLRVDQDELETVIPQIGGLVRIVNGAYRGSNARLLSVDTEKFCAKVQVEKGLYDGKVLRAVEYEDICKISS

SEQ ID NO: 4804 - protein, 247 aa, Panicum virgatum
MGKHEFLTPKAIANRIKAKGLQKLRWYCQMCQKQCRDENGFKCHCMSESHQRQMQVFGMAPERVVEGFSEEFLELFLALIRRAHRHSRVAATVVYNEYIADRHHVHMNSTRWATLTEFVKFLGREGYCKVEDTPKGWFMTYIDRDSEQAVKARLKRKRIKSDMAEDERQERMIARQIERAQKSLAKANDGDDGNVAEGESESEYDSEEEYSDSDDGGEKRENGSKEANKATGKDCDCSSEVCTRAEG

SEQ ID NO: 4805 - protein, 430 aa, Oryza sativa
MGKHEFLTPKAIANRIKAKGLQKLRWYCQMCQKQCRDENGFKCHCMSESHQRQMQVFGQAPDRVVEGFSEEFLDAFLTLLRRAHRHSRIAATVVYNEFIADRHHVHMNSTRWATLTEFVKFLGREGHCKVEDTPKGWFITYIDRDSEQAVKARLKRKRIKSDLAEDERQERMIARQIERAQQSMGKTNGELGDDASPDGSEGESGSEDEYSDSENDHEGQEEDAKEANKAAGKIAIALQRAVPGPKVNPLDDKPKVKFGFEEEDEVSARDKEKEELAKKKGKDAINAAEARRSALDELMKEEEKAKERSNRKDYWLCPGIVVKVMSKSLAEKGYCKQKGVVKRVIDKYVGEIEMLESKHVLRVDQDELETVIPQIGGLVRIVNGAYRGSNARLLSVDTERFCAKVQVEKGLYDGKVLKAIEYEDICKIFH

SEQ ID NO: 4806 - protein, 416 aa, Brachypodium distachyon
MGKSDFLTPKAIANRIKAKGLQKLRWYCQMCQKQCRDENGFKCHCMSESHQRQMAIFGQAPDRVVEGFSDEFLEEFLTLLRRAHRSSRVAATVVYNEFIADRHHVHMNSTRWATLTEFVKFLGREGHAKVEETPKGWFLTYIDRDSEQAIKDRLKRKRVKSDLAEDERQELMIARQIERAQQSMSKANGDEDDADAEGVTGSEDEYSGSDDDQEEPEEEDVKEANKTTRKIAIALQRAAPPPKVNPFDDKPKMKFGFEEEEEVVNKKGKDAGKAAEPRRSAIEDLMKEEENAKERSNRKDYWLCPGIVVKVMSKSLAEKGYYKQKGLVKRVIDKYVGEIEMLESKHVLRVDQDELETVIPQIGGLVRIVNGAYRGSNARLLAVDTERFCAKLQVEKGLYDGKVLRAIEYEDICKVA

SEQ ID NO: 4807 - protein, 381 aa, Oryza sativa
MSETDSSAAAAEGRKPRRLRGHKKGAVTCCVASSSRPGVVASSGEDGCLCWFDLRTKDVLFTMEATNQPISSVCFKAGNEDLVYASAGNEILSFDVRMGPQAKPLDTYNYNRDEINQIAVSSKGFLAAADDSGDVKIINTIQKSLYKRLREAHTSICSSVQFIPWRPWTAITGGLDSKLAVWDFSKGRTLFSIDYGSPEMQNGSSGGQCFNPPFVHSIAVSEEGILGGSYKVCAVARGDGAVDVVDLEYELAPAKSKGLPRMADLSLSSKRTDLGDGCGSQSQGNRIHLDYTVGGHTSSVSCVTFSAFGEKGKFLVSGGNDSSIKLWDWSKGFSSETNNSAELVLDIKVNKKVNWLCTTPTDSDNLIVCDTSKVVKVYNLP

SEQ ID NO: 4808 - protein, 440 aa, Zea mays
MDPSISSSSSPLRLPGTPTSPGASPRPTLVAAGRQPAAAPSTTRLRAISPSQSPPTPASPVEPFGFDALKGTFSVDVAAADARSLDVPLAAPFTIASSRLVAVSNVAVRVELRTGAVGWGEAPVLPSVTAEDQPAALDAAGRACAALVGAPAAPLGAVLQDLASVLPGHAFASARAGVEMALIDAVANSIGIPLWRLFGGASDSLTTDITIPIVTPNEAAQLAAKYHGQGFQTLKLKVGKNLNSDIEVLKAIRLVHPDCSFILDANEGYTAKQAIEVLDRLNEMGVTPVLFEQPVHRDDWDGLRDVTSVAMEKYKVAVAADESCRSLLDAQKIIDGNLAHVINIKLAKLGVLGALEIIDAARKANIALMIGGMVETRIAMGFAGHLAAGLGCFSFIDLDTPLLLSEDPVYGGYEAFGPLYKFTNARGHGGFLHLDNEASK

SEQ ID NO: 4809 - protein, 442 aa, Setaria italica
MDPSISSASSPLLRLHGTPGAANASPRPSLVAAARQPASSATPLRAVSPSPSPSRPAPASPAAEPFGFDALKETFSVDVAAAEARPLAVPLAAPFTIASSRLDAVSNVAVRVELRSGAVGWGEAPVLPSVTAEDQPAALAAAGRACGALEAAPAAPLGALLQDVAGVLPGHDFASARAGVEMALIDAVANSIRIPLWRLFGGASDTVTTDITIPIVAPNEAAQLAAKYRGQGFQTLKLKVGKNLNSDIEVLKAIRLVHPDCSFILDANEGYTADQAIEVLDRLNEMGVTPVLFEQPVHRDDWEGLRDVSIVAMEKYKVAVAADESCRSLLDAQKIINGNLAHVINIKLAKLGVLGALEIIDAARKANVALMIGGMVETRIAMGFAGHLAAGLGCFSFVDLDTPLLLSEDPVYGGYEAFGPLYKFTNARGHGGFLHLDNDGSK

SEQ ID NO: 4810 - protein, 442 aa, Brachypodium distachyon
MDTSVSSSSSSPLLRLSRNSTSPRSTVNPGPRVAPARGGGRQLPAVTRLRAISPSPSPTPPMETFGFEALKETFSVDVSAAEARPLDVPLAAPFTIASSRLESVSNVAVRVELSSGAVGWGEAPVLPSVTAEDQPAALAAVGRACAKLAGAPSAPLGAVLEDVAAALPGHAFASARAGVEMAVIDAVANSIRVPLWRLFGGASNSVTTDITIPIVTPNEAAQLAAKYRGQGFQTLKLKVGKNLNSDIEVLKAIRLVHPDCSFILDANEGYTANQAIEVLDRLNEMGVTPVLFEQPVHRDDWEGLRDVSTAAMEKYRVAVAADESCRGLLDAQKIINGNLSHVINIKLAKLGVLGALEVIDAARKAGIALMIGGMVETRIAMGFAGHLAAGLGCFSFIDLDTPLLLSEDPVYGGYEASGPLYKFTNARGHGGFLHLDNNNGSK

SEQ ID NO: 4811 - protein, 446 aa, Triticum aestivum
MDASTTSSSSPLCFAQKPPSPRPLLNPTPRATHAGAGRQRATRLRGISPSPSPSPPTPQQQQQQPMEAFGFDALKETFSVDVAAAEARPLNVPLAAPFTIASSRLDAVSNVAVRVELSSGAVGWGEAPVLPSVTAEDQPAALAAVGRACAALVAERSAPLGAVLQDVADALPGHAFASARAGVEMAVIDAVANSIRIPLWRLFGGASNTVTTDITIPIVTPNEAAQLAAKYRGQGFQTLKLKVGKNLNSDIEVLKAIRLVHPDCSFILDANEGYTANQAIEVLDRLNEMGVTPVLFEQPVHRDDWEGLRDVSIAAMEKYRVAVAADESCRGLHDAQKIIHGNLAHVINIKLAKLGVLGALEVIDAARKAGIALMIGGMVETRIAMGFAGHLAAGLGCFSFIDLDTPLLLSEDPVYGGYEASGPVYKFKNARGHGGFLHLDNNNGWK

SEQ ID NO: 4812 - protein, 434 aa, Secale cereale
HILLTPSPLRPQASQREPTPQPRPTIHPSRRRPPPRHLAVADAVPSDAAAAAADGGVRLRRAQGDLLGGRGGGGGAPAQRAARRALHHRLLAARGRRQRRRAGRALQRRRRLGRGPGLPSVTAEDQPAALAAAGRACAALVAARSAPLGAVLQDVADALPGHAFASARAGVEMAVIDAVANSIRIPLWRLFGGASNTVTTDITIPIVTPNEAAQLAAKYRGQGFQTLKLKVGKNLNSDIEVLKAIRLVHPDCSFILDANEGYTANQAIEVLDRLNEMGVTPVLFEQPVHRDDWQGLRDVSVAAMEKYRVAVAADESCRGLHDAQKIINGNLAHVINIKLAKLGVLGALEVIDAARKAGIALMIGGMVETRIAMGFAGHLAAGLGCFSFIDLDTPLLLSEDPVYGGYEASGPVYKFKNARGHGGFLHLDNNNGWK

SEQ ID NO: 4813 - protein, 446 aa, Oryza sativa
MDSAISTSSSFSPLRLSQNHGSIMSGSTRAQVLPVGRQQQQPPAGGATRLRAVSPSPSPTPPAPQPAETFGFDALKEAFSVDVVAAEARPLNVPLAAPFTIASSRLDAVSNVAVRVELRSGAVGWGEAPVLPSVTAEDQPGALAAATRACGALAGAPAAPLGAVLQDVASALPGHDFASARAGVEMALIDAIANSIRIPLWRLFGGASDSVTTDITIPIVTPNEAAQLAAKYRGQGFQTLKLKVGKNLNSDIEVLKAIRLAHPDCSFILDANEGYTANQAIEALDRLNEMGVTPVLFEQPVHRDDWEGLRDVSIVAKEKYRVAVAADESCRSLLDAQKIMDGNLAHVINIKLAKLGILGALEVIDAARKARIALMIGGMVETRIAMGFAGHLAAGLGCFSFVDLDTPLLLSEDPVFGGYEVSGPVYKFTNARGHGGFLHLDNNGLK

SEQ ID NO: 4814 - protein, 451 aa, Hordeum vulgare
MDGSISTSISSSRSSPLRFSHNPPTPRPLLSPTPRLTPASAGRQPSARLRAISPSPSPSPTTPQQRQQEPMEAFGFDALKETFSVDVAAAEARPLNVPLAAPFTIASSRLEAVSNVAVRVELSSGAVGWGEAPVLPSVTAEDQPAALAAVARACELLVAARSAPLGAVLQDVADALPGHAFASARAGVEMAVIDAVANSIRIPLWRLFGGASNTVTTDITIPIVTPNEAAQLAAKYRGQGFQTLKLKVGKNLNSDIEVLKAIRLVHPDCSFILDANEGYTANQAIEVLDRLNEMGVTPVLFEQPVHRDDWEGLREVSIAAMEKYRVAVAADESCRGLLDAQKIIHGNLAHVINIKLAKLGVLGGLEVIDAARKAGIALMIGGMVETRIAMGFAGHLAAGLGCFSFIDLDTPLLLSEDPVYGGYEASGPVYKFKNARGHGGFLHLDNNNGWK

SEQ ID NO: 4815 - protein, 467 aa, Secale cereale
TRESRSPARSSTSTEPSLRSAAGHGRLHLHLHLLHHILLIPSPLRPQASQPEPTPQPRPTIHPIRRHPPPRHLAVADAEAAEAAAADGGVRLRRAQGDLLGGRGGGGGAPAQRAARRALHHRLLAPRGRRQRRRAGRALQRRRRLGRGPRAALRHRRGQPAALAAAGRACAALAAARSAPLGAVLQDVADALPGHAFASARAGVEMAVIDAVANSIRIPLWRLFGGASNTVTTDITIPIVTPNEAAQLAAKYRGQGFQTLKLKVGKNLNSDIEVLKAIRLVHPDCSFILDANEGYTANQAIEVLDRLNEMGVTPVLFEQPVHRDDWQGLRDVSVAAMEKYRVAVAADESCRGLHDAQKIINGNLAHVINIKLAKLGVLGALEVIDAARKAGIALMIGGMVETRIAMGFAGHLAAGLGCFSFIDLDTPLLLSEDPVYGGYEASGPVYKFKNARGHGGFLHLDNNNGWK

SEQ ID NO: 4816 - protein, 605 aa, Setaria italica
MFDWNDEQQQVGDAIWAEFNDSEDHIVPYPKHAEDSTLVRVGNHKNNDEEAASIADITKHSAGDQTELQGMEKQHANQTSAHFSATRLDMESWPDLPSLNPALDRNYSDDNIASTYLDFSAEPSLQKVTGNTTVQLDGESEVFGNDHEEKSSSFLDCDWGNIGDFDDFDRLFSNSDSIFGNEVVANDSDFLSASSDMMDNVVQSIPIPQVPLNKQPLSHHGPSLLLINEISGGITKQENKGDVQKRPVRSRRKQEERGKSKLSSDTSGFSQSKVQNPSASLQAPMQPVQTPQYALFQDSKNMGQVQHSNQFICPGYGYPAYPFPTIPLVSNIQAEDHQRKPAATSYQTSADSPKHSSSIEMSQDIPSRPLRMTPKEKIEKLRRRQQMQALIAIQQQQQQFGQEGSGSDTIVLQPYSPRNKNADSLGSSIVIDENTNKDFLPEMIPTSHDEVHKSFAISEDPFIEEKIYYQLQDALGKLDTKTRLCIRDSLLRLACSATERQIAGDRSSTNKTTKDEDEASEHDTSTRRTRSPTKEAETTTNPIDRIVAHLLFQRHCSKVATATKEEIISSTHLKIEPESKVPLETPRVPSEDRKDKQEMVLQPSQ

SEQ ID NO: 4817 - protein, 797 aa, Zea mays
MGSDLKEMKYRRRIGAEERPQCSDRRGGAGWAALQQDPVELLRKLDELRDQIARSCNVVAQRREPRRASRRAVSMLPAEHLEEPPPLPGYHRSRHGGRFGPGLPPPGPYAPPRPEHGERYVRQSSGHYRQYPGRQWENGGMGPGSFHHYGCACPHCLHGQRTSPQEENIPMARYFARQHESYRFERSPSVSSDYDRRSVASSLYSHRSVSKRRAEYFRKKAEHICRPVDGAAPFSVCSSCYKLLQMPTEKCIGRKQNRFQCGSCCQIVSLKHDEENGIPFAPSLSLYAPETEQSSSDQMRRDTVHQHHEDFNSMFYNSNDHSNMQNNMDSTDDNSLSSTMSNDRIGKDCGSTRSIQSKAEDLPFSPSRSVDNGSPKDILCERDTDCKVEPSVGGPVSPRSPALEDKLVDPLCAQEKCNDEDDQGMAMAYKSDLTCKGEYDVNDQYDGGISTRSKQESNEDDKDATEDEISCRSYEQKSKEDNSCNIEDSSKTYEQNSGEDDTSSLVNGSEKYQCMNIKDEDSSPGGEDTCNKYESKVKRDENYVLGAESIRKNCDENNADVMETGSISERHDGLKIEEDNEKLQQPFIEDANSQTGSGSSVNERTNSGFSRGSSEAGLDEDQSSTGKSGDSSFFAGFLKKGFKDLSLLNKSMDNVKVSINGHPISEKALKKAEKKAGPVDPGTYWYDYHAGFWGVMGRECIGIVPPFIREFNYPMAKNCAGGDTGVFVNGRELHQRDLDLLVGRGLPRTSGMSYSIEMSGNVIDEATGKKLRSLGKLAPTIEKLKRGFGMHVPEEFR

SEQ ID NO: 4818 - protein, 794 aa, Zea mays
MGSDLKEMKYRRRIGVEERPQCSDPRGGADWAALQQDPVELLRKLDELRDQITRSCNVVVGQPREHRRVSRRAVSMLPEHLEPPPLPGYHRSRYGGRYGHGLPPPSPYAPPRPEHGERYARQSSGHYRQYPPRHCENGGMGPGTYHHHGCACPHCLHGQRTFPQEENIPMARYFAGQHESYRLERSPSVSSDYDRGSVASSLYSHRSVSKMRAEYFRKKAEHICRPVDGAAPFSVCSSCYKLLLMPMEKCVGRKQNRFQCGSCCQIISLKHQEENGIPFALAPSSSLHAPEMEQSTSDQMRQDSVHQRHEDFNFMFNNSNDHCDMQNNMDFTDDNSLPSTASNDRIEIDKECGSTRSIQSKAEGLSFSPSRSVDIGSPKDILCERDKDSNVEPSSDGPLSPRSPTLEDKLVDPLCAQEKGNDEDDQGTAYRSNLTCKGEYDANDEYDGDVSTRSKPESNVNDKDTTEGETSCRNYKEDNCCNIEDSSKTYEQNSGEDDTSSLVDGNEKYESMNTKDDDSSPGGEDTCNRYEPKVEDDENCVLGAESISNNCDENNKDAIKTGSISERHEELIIEEENEKLQQAFIEDANSQAGSGSSINERTNSGFSRGSSEAGLDEDQSSTGKSGDSSFFAGFLKKGFKDLSLLNKSMDSVKVSINGHPISERALKKAEKKAGPVDPGSYWYDYRAGFWGVMGRECIGIVPPFIREFNYPMARNCAGGDSGVFVNGRELHQRDLDLLVGRGLPRTSGKSYSLEMSGNVIDEDTGKKLRSLGKLAPTIEKLKRGFGMHVPEEFR

SEQ ID NO: 4819 - protein, 792 aa, Setaria italica
MGSDLKEMKYRRRIGVEERPQCSDPRGGADWAALQQDPVELLRKLDELRDQITRSCHVVGQPREHRRVSRRAVSMLPEHLEPPPQPGYHRSRYGGRYGHGLPPPSPYAPQRPEHGERYVRQSSGHYRQYPGRQWENGGMAPGSYHHYGCACPHCLHGQRAAPQEENIPMARYFAGQHESYRFERSPSVSSDYDRRSVASSLYSHRTVLKRRAEFFRKKAEHICRPVDGAAPFAVCSSCYKLLQMPVEKCIGRKKNRFQCGSCCQIISLKHDEGKGIPLTPSSSLYVPEMEQSSNDQMMKDSTHQRQEDFNSVFYNANEHSSMQFNMDFADDNSLSSTTSHGRTDKEYGSNRSIQSKAEGLSFSPSRSLDAGSPKDILCERDAGCEAEPSVDGSVTPRSPVLEDKLVDPLCTQEKGNNEDAMAYRSDITCKGEYDVNDDYDESVSTRSKQKGNDDDKDATEDESSRSSYEQKDKEDNCCNLEGGNKMHKQNSVKDDSSSLEDGSEKYEYTNIKDDNSSPGGSEDSSKYEPKAKGDEKCVLGSENISNNCDEDNKDNAIEAGSTSERHDELKTEEDYGKLQRPFTEDANSPAESGSSVNGRTNSGFSRGSSEAGLDEDQSSTGKSGDSSFFAGFLKKGFKDLSLLNKSMDSAKVSINGHPISERALKKAEKKAGPVDPGSYWYDYRAGFWGVMGRECIGIIPPFIREFNYPMARNCAGGDTGVFVNGRELHQRDLDLLVGRGLPRISGKSYSIEVSGDITDEATGKKLRSLGKLAPTIEKLKRGFGMHVPEEFR

SEQ ID NO: 4820 - protein, 604 aa, Setaria italica
MSAPIDRFATTRDEGHACSDEKRECNSDEENSEGERRVKRGSFKKRAITAGYKFRHSLRRKSRTKSGNHVVSIEDIRDVQELETVERFRRCLLDEGLLPERHDDYHTMLRFLKARKFNIEKAKHMWSEMLRWREEFGADNIEEFDYSELHEVVKYYPQFYHGVDKEGRPVYIELIGKVDTNKLVQITTIDRYVKYHVKEFERCLQMRFPACSIAAKKHIDSSTTILDVQGVGLKNFSKDARELIMRLQKINNDNYPETLYQLYIINAGQGFKMLWGTIKSFLDPETASKIHVLGSKYQAKLLEIVDSSELPDFLGGKCRCEEHGGCSKSDKGPWKDPEIIKRVLNGEANYGRRVLAVSSINQKEVGCTEPQHTTGKGNDVSAESSSEVEDVSSPTASVNPIIIPNLTHVHESKFPGHASTSDAPPIVEDNIPVVNKVVDACSDPRNSSMASTSGSFSLRNTPATLGGLKTQIVAWLTVLIVSLLAFLRSVPTIMTKRLTNQVITCDHYSAEYPPQGNTGNGTLTSVLRRLGELEEKVQTLEVKPHQVPFEEELLNAAIRRVDALEAELISMKKALYEALIRQDELLAYIDRQQQVKFCRKKKCF

SEQ ID NO: 4821 - protein, 280 aa, Panicum virgatum
  misc_feature (179)..(179): Xaa can be any naturally occurring amino acid
  misc_feature (216)..(216): Xaa can be any naturally occurring amino acid
ECNSDEENSEGERKVRRGTFKKRAINAGHKFRHSLRRKSRTKSGNHVVSIEDIRDVQELEIVERFRRCLLDEGLLPERHDDYHTMLRFLKARKFNIEKAKHMWSQMLKWRKEFGADNIEEFDYSELHEVVKYYPQFYHGVDKDGRPVYIELIGKVDTNKLVQITTIDRYVKYHVKEFEXCLQMRFPACSIAAKKHIDSSTTILDVQGVGLKNFSKXARELIMRLQKINNDNYPETLHQLYIINAGQGFKMLWGTLNHFLIQKLLQKSTSLEASMKLSYLK

SEQ ID NO: 4822 - protein, 156 aa, Panicum virgatum
MQSKFPGHASTSDAPPIVEDSIPVVDKVVDTCSDPRNSSVASTSGSFSLRNTPATLGGLKTQIIVWLTFLIVSLLAFLRSVLCIMTKRLTNQAITCDHYSAEFPPQGYTGNGTLTSVLRRLDELEEKVQTFEVKPPQVPFEKEELLNAAVHRVDAC

SEQ ID NO: 4823 - protein, 620 aa, Pennisetum glaucum
MSAPIDRFATPIDEGPARSDEKRECNSDEENSEGERRVKRGSFKKRAITAGCKFRHSLRRKSRTKSGNHVVSIEDIRDVQELETVERFRQCLLDEGLLPERHDDYHTMLRFLKARKFNIEKAKHMWSEMLRWRKEFGADNIEEFDYSELHEVVKYYPQFYHGVDKEGRPVYIELIGKVDASKLVQITTIDRYVKYRVKEFERCLQMRFPACSIAAKKHIDSSTSILDVQGVGLKNFSKDARELIMRLQKINNDNYPETLHQLYIINAGQGFKMLWGTIKSFLDPETASKIHVLGTKYQTKLLEIIDGSELPDFLGGKCRCEAYGGCPKSDRGPWTDPEIIKRVLNGEANYGRQILAVSSINQKEVDCTEPQHTIGKCNDASAESSSEVEDVSSPTASANPIISPNLTHVHESKFSGHASTSDAPPILEDSIPTVDKVAPPILEDSIPTVDKVVDACSVPRNSSMASTSGSFSLRNTPATLGGLKTQFVAWLTFLIVNLLAFLRSIPSVMTKKLTNQPITCDHYSADFPPQGYTGNGTLTSVLRRLGELEGKLQTLEVKPPQVPCEKEELLNNAVRRVDALEAELISMKKALYEALIRQDELLAYIDRQQQVKFCRKKLCF

SEQ ID NO: 4824 - protein, 1118 aa, Setaria italica
MLVPHQDVIEGAQQAVVEGPQQDVVEGPQQDVVEGPQPMEESASTVENQTVPDPCTSRFTWTIENFFKRNVRKHYSDDFVVGGYKWRVLVFPKGNNVDNLSMYLDVADANFLPPGWSRYAQFSLAVVNQIDSKMSLRKEATHQFNARESDWGFTSFMPLMDLYDSSKGYVVNDKCIIEAEVAVRKIVDFWNYDSKKMTGYVGLKNQGATCYMNSLLQTLYHIPYFRKAVYHMPTSENDTPSGSIPLALQSLFYKLQHNDNSVATKELTKSFGWDSYDSFMQHDVQELNRVLCEKLENKMKGTTVEGAIQKLFEGHHMNYIECINVDHKSTRKESFYDLALDVKGCSDVYASFDKYVAVERLEGDNKYQSEEHGLQDAKKGMLFVDFPPVLQLQLKRFEYDFVRDTMVKINDRYEFPLQLDLDRDDGKYLSPEADRSVRNLYTLHSVLVHSGGVHGGHYYAFIRPTLSDQWYKFDDERVTKEDTKRALEEQYGGEEELPHTNPGLNTTPLRFTKHSNAYMLVYIRESDKEKIICDLDEEDISEHLKVRLRKEQEEKEYKKREKAEAHMFTALKVAWDSDLKEQIGRHVHFDLVDFDKVHSFRAPKNMSINEVKMELSKEFGIPVESQRFWVWAKRKNSTYRPSRPLTLQEEKTAIGLLKDATVTKFQTSEVRLFLEVHFGQENQPIAPPVKTKEDILLFFKLYDPEKEDLRYVGKFFVKASGKPFDIVERLNQIAGFPSDEDIDLYEEIMYDPSVMCEPIESNVSFHSSQIENGDIICYQKRCLPDKMDQYRYPTVSSFFEYIHNKQIVRFRLLEKPKEDYFSLELSKRSTYDDVVEKVAHQLGLDEPSKIRLTQHHPLSHQPKPYYIKYRGLDYLSDMLQHHNQMCDILYYETLDIPLPELEGLKTLKVAFQNAKNCEASFHIMRSPKSNALFDLIEDLKSKVELSCNDAEFRFFNVHLHKICKVYQPGDKIDSVSDQSGPLRIEEVPEEEKNAGPNDRLVHVYHFFKDIHHIQYFGEPFFFLIRDGEALSDIKVRIQKRLQVPDEQFLKWKFAYVTYGRPEYLQDSDIVLSRFQKQKPIYGAWEHILGLEHTATTPKRSFLASQNRHSFEKPVKIYN

SEQ ID NO: 4825 - protein, 657 aa, Zea mays
MSLSPLDSSSPPAAAAAAATEVPLAPGFRFHPTDEELVSYYLRRRVLGRRLRVDAIAEIDLYRLEPWDLPSLSRIRSRDAQWYFFARLDRKVAGAGAGGRGGPGNRTNRATPRGYWKTTGKDREVHHRGKPVGMKKTLVFHAGRAPKGERTNWVMHEYRLLDADGPQDLHVVCRIFQKHGSGPQNGAQYGAPYMEEEWEEDDDAIENGSTHDASGQIAATTCAVDEESNEDDENAYCETNRPARVEPSHLPSVHEMLNPPEMAPLQGQDSKETSDGSCSDVAISLEEILQEPLSNISVENMHRLEGQNATDDNISVDNLLSAYPTKDNGYVGQYNTMNGSAPADEAHARWPLRTYSNQNYVNGPLADEFFDTGNDTNGVAYSRQQQADGFPAPRQVDESMVFYDAPSDYNLVDGKDDFVYLNDILNEPLGNESLFDGDDMMAYFDATENDFKYDILGSGQGLDYPLADMPLNFAQKSDKEDKFTFEGISEVPEANPQYGASSSGSHEDLYTDTEFLGVPTDDTADKTYGNRLASMLGSIPAPPAMASEFPPSTGKSAGMLSAVSSSSIRFTAGIIQLDGLTFSSGSGQWPLQKNGDLSLLVSFAVEGDVASKLPVGLGRATRISTVPMVLRSGFYLFFMSAMILLFSYKVGSCIYSR

SEQ ID NO: 4826 - protein, 256 aa, Panicum virgatum
MSTSLSPPDSSPPPAEVPLAPGFRFHPTDEELVSYYLRRRVLGRRLRVDAIAEVDLYRLEPWDLPSLSRIRSRDAQWYFFARLDRKVAGAGAGGRGGPGNRTNRATPRGYWKTTGKDREVYHRGKAVGMKKTLVFHAGRAPKGERSNWVMHEYRLLDADGPQDLHVVCRIFQKHGSGPQNGAQYGAPYMEEEWEEEDDAIENAPANGTSAGMATITCTVDEESNEEDENGYCKTNELAQVSSTILFAFGPWNAQLT

SEQ ID NO: 4827 - protein, 636 aa, Panicum virgatum
MSTSLSPPDSSPPPAEVPLAPGFRFHPTDEELVSYYLRRRVLGRRLRVDAIAEVDLYRLEPWDLPSLSRIRSRDAQWYFFARLDRKVAGAGAGGRGGPGNRNNRATPRGYWKTTGKDREVYHRGKPVGMKKTLVFHAGRAPKGERSNWVMHEYRLLDADGPQDLHVVCRIFQKHGSGPQNGAQYGAPYMEEEWEEEDDAIENAPASGTSAGMATITCAADEESNEEDENGYCKTNELAQAHGMLSSPEMAPLKAQGSKDTSEGSCADGVISLEEIMQEPLSAENIGRSEGQNATDDNFSVDDLLSACPTKDNDYVGQDGTLNGSYPADGDCTHWPLRAYSNQNYANGTLSAEEFFDTQNDSNGNTYSEYQQADGFPAPHQVDGSMVFYDAPSDYNLVDGNDDFVYLNDLLNEPLGNESLFDGDDMMAYFDATENDFKYDILGSAQGSNYQLADMPLNFSQKGDNKDKFTLDGISKSSEENTQYGASSSGSHKDLYPDTAIPDDTVDKTFGKRLASMLGSIPAPPAMASEPSATGKSVGALSAVSPSSIRVTAGIIQLDGLTFTGVSERWPLQKNGDFSLLLSFTVESDVPSKPVGFEQATRMSTIPMVLRSGMYLFFVSAMILLLSYKVGSCIYSR

SEQ ID NO: 4828 - protein, 636 aa, Panicum virgatum
MSTSLSPPDSSPPPAEVPLAPGFRFHPTDEELVSYYLRRRVLGRRLRVDAIAEVDLYRLEPWDLPSLSRIRSRDAQWYFFARLDRKVAGAGAGGRGGPGNRTNRATPRGYWKTTGKDREVYHRGKPVGMKKTLVFHAGRAPKGDRSNWVMHEYRLLDADGPQDLHVVCRIFQKHGSGPQNGAQYGAPYMEEEWEEEDDAIENAPASGTSAGMATTTCAADEESNEEDENGYCKTNELAQAHGMLSSPEMAPLKAQGSKDTSEGSCADGVISLEEIMQEPLSAENIGRSEGQNATDDNFSVDDLLSACPTKDNDYVGQDGTLNGSYPADGDCTHWPLRAYSNQNYANGTLSAEGFFDTQNDSNGNTYSEYQQADGFPAPHQVDGSMVFYDAPSDYNLVDGNDDFVYLNDLLNEPLGNESLFDGDDMMAYFDATENDFKYDILGSAQGSNYQLADMPLNFSQKGDNKDKFTLDGISKSSEENTQYSASSSGSHKDLYPDTAIPDDTVDKTFGKRLASMLGSIPAPPAMASEPSATGKSVGALSAVSPSSIRVTAGIIQLDGLTFTGVSERWPLQKNGDFSLLLSFTVESDVPSKPVGFEQATRMSTIPMVLRSGMYLFFVSAMILLLSYKVGSCIYSR

SEQ ID NO: 4829 - protein, 638 aa, Setaria italica
MSSLSPLDSSPAAEVPLAPGFRFHPTDEELVSYYLRRRVLGRRLRVDAIAEVDLYRLEPWDLPSLSRIRSRDAQWYFFAHLDRKIAGAGAGGRGGPGNRTNRATPRGYWKTTGKDREVYHRGKAVGMKKTLVFHAGRAPKGERSNWVMHEYRLLDADGPQDLHVVCRIFQKHGSGPQNGAQYGAPYMEEEWEEEEDAIENAPVSGASAGMAAITCAVDEESNEEDENGYCKINELAQAHEDSPEMAPLQAQGSKDTSDGSCADGVISLEEILQEPLSNINAENIGSSEGQNATDDNFSVDDLLSTCPTKDDGYVGQDGTLNGSYPEDGNHTNWPLRAYSNQNYANGTLSAEEFFDTQNDTNGNAYSEYPQADGFPVPHQQVDGSMVFYDAPSDYNLVDGNDDFVYLNDLLNEPLGNESLFDGDDMMAYFDATENDFKYDISGSAKSSNYQFAEMSTNFAQKGDNKVGFTFDGIAKASEANVQYSASSSGSHEDLYPDSAVPDDDTGDKTFGKRFAGMLGSIPAPPAMASEFPPATGKSVGVLSAVSPSSIRVTAGIIQLDGLSFTGASERWPLQKNGDFSLLLSFTVESDMSTKAACFEQASRMSTIPMVLRSGMYLFFVSAMILVLSYKIGSCIYSR

SEQ ID NO: 4830 - protein, 577 aa, Zea mays
MAAASSSMDRIAQWVSSQEVPTDLTVRIADSVFSLHKAVMVPKCGYIRRAVAASQTQGPGGGAVELDLSALPGGADAFQKAARCCYGDSLEITARDAAALRCAAEFLDAPDLARRADDFLAQAALRALPGAAAVLRSCEALLPAADELGVARRAADAVALGVCNEALFPTPRAPPGWWAAELAALSPASFRRVVAALRCRRAGPEVVAAAAAAYAERVLAGVLAAPGRRDADQRALLEAVVDALPPAADAPLPAAFLCRLLRAAVTAEASAKTCRDMELRVAAVLDQATAGDLLGVALDGAGERVVNADTVRRVVAACVERQQTQQGRRASLAGGPAGELSALEKVAKTVDEVAAEMASHESLPISKFVGVAGAVPRDARPSHDCLYRAVDIYLKTHPGLDEIEREKVCSVMDPLRLSYQARMHASQNKRLPLQAVLSVLYYDQLKIRSADGSGGTEEGWETQSAAGKARAQARADVSLARENEALRLELARMRAYVSGMQQSSKGSGSRPSSSSLVPGPATATGKKASFLGSVSRTLSRLNPFKGGWAKDTTSIADGRDRTSMHVVKPKRRRFSIG

SEQ ID NO: 4831 - protein, 111 aa, Zea mays
MDHVARLASERAVVVFTASNCSMGDVVTSLLSSLGVNAAVHDLDRDPRGMEMERELARRLGGGGGRGTTTTPTVPAVFVGGDLVGGTNRVMALHLSGELVPMLRKAGALWL

SEQ ID NO: 4832 - protein, 110 aa, Setaria italica
MDRVARLVSERAVVVFTASNCSMCDVVTSLLGSLGVNAAVHDLDRDPRGREMERELARRLGGGSGPGGSTPTVPAVFVGGDLVGGTNRVMALHLAGELVPMLRNAGALWL

SEQ ID NO: 4833 - protein, 112 aa, Panicum virgatum
MDRVARLASERAVVVFTASNCSMCDVVPSLLGSLGVNAAVHELDRDPRGGRWSGSSPGGSAPAPCTAAAHGTPTVPAVFVGGDLVGGTNRVMALHLAGELVPMLRNAGALWL

SEQ ID NO: 4834 - protein, 113 aa, Panicum virgatum
MDRVARLVSERAVVVFTASNCSMCDVVTSLLGSLGVNAAVHELDRDPRGREMERELARRLGAGAAGAVRGGVTPTVPAVFVGGDLVGGTNRVMALHLAGELVPMLRNAGALWL

SEQ ID NO: 4835 - protein, 109 aa, Sorghum bicolor
MDRMAKLASERAVVVFTASNCSMGDVVASLLNSLGVNAAVHDLDRDPRGQEMERELASRLGAGAGGRGSPAVPAVFVGGHLVGGTSRVMALHLAGELVPMLKSAGALWL

SEQ ID NO: 4836 - protein, 107 aa, Setaria italica
MERVAALASERAVVVFTASNCSMGNVVVSLLSSLGVNAAVHEVDRDPRGREMEQDLARRLAGSSGGTPTVPAVFVGGNLVGGTARVMALHLAGELVPLLRSAGALWL

SEQ ID NO: 4837 - protein, 342 aa, Saccharum officinarum
MEKMLHAAPVHATLPECFIFPADKLPQAKATSATVSLPIIDLSLGRDEVRRAILDAGKEIGFFQVVNHGVSLEAMRDMEAACQEFFALPAEDKAGLYSEDTGKTTRIYSSTMFDTGAEKYWRDCLRLACSFPDVGDSPKNWPDKPARLREVVERFTVQTRGLGMQILRLLCEGLGLRPDYLEGDISGGDVVLHVNHYPPCPDPTATLGLPPHCDRNLLTLLLPSMVRGLEVAYSGDWIKVDPVPGAFVVNFGCQLEVVTNGVLKSIEHRVMTNLGVARTTVATFIMPTTDCLIGPAAEFLSDDNPPAYRTLTFGEFKRIYSVVKLGSSLNLTTNLKDVQKEL

SEQ ID NO: 4838 - protein, 339 aa, Setaria italica
MDKMLHSAPIHTNLPDCFVFPADKRPPATAAVVSLPIIDLSRSRDEVRRAILDAGKEIGFFQVVNHGVSEQAMQDMEAVCQEFFQLPAAEKAELYSEDTQKATRIYSSTMFETGGERYWRDCLRLACSFPVADSPMAWPDKPQRLREVVEKFTVQTRGMGMEILRLLCEGLGLRHDYLEGDISGGDVVLHVNHYPPCPDPSTTLGLPPHCDRNLLTLLLPSMVPGLEVAYYGDWIKVQPVPNAFVVNFGCQLEVVTNGLLKSIEHRVVTNLGVARTTVATFIMPTTDCLIGPAEEFLSEDNPPCYRTLTFGEFKRIYSVVKLGSSLNLTTNLKNVQKET

SEQ ID NO: 4839 - protein, 345 aa, Cenchrus ciliaris
  misc_feature (31)..(31): Xaa can be any naturally occurring amino acid
  misc_feature (40)..(41): Xaa can be any naturally occurring amino acid
  misc_feature (43)..(43): Xaa can be any naturally occurring amino acid
  misc_feature (45)..(47): Xaa can be any naturally occurring amino acid
  misc_feature (261)..(261): Xaa can be any naturally occurring amino acid
  misc_feature (287)..(287): Xaa can be any naturally occurring amino acid
  misc_feature (341)..(342): Xaa can be any naturally occurring amino acid
MEKMLHSAPVHTNLPDCFVFPADKRPPASAXVVSLPIIDXXLXRXXXRRAILDAGKEIGFFQVVNHGVSEQVMQEMEAVCQEFFQLPAAEKAALYSEDTQKATRIYSSTMFETGGERYWRDCLRLACSFPDVGDSAAAWPDKPPRLREVVERFTVQTRAMGMEILRLLCEGLGLRRDYLDGDISGGDVVLHVNHYPPCPDPSATLGLPPHCDRNLLTLLLPSMVPGLEVAYNGDWIKVQPVPNAFVVNFGCQLEVVTNGLXKSIEHRVVTNLGVARTTVATFIMPTXDCLIGPAEEFLGDDNPPCYRTLTFGEFKRIYSVVKLGSSLNLTTNLKNVQKETXXEAK

SEQ ID NO: 4840 - protein, 386 aa, Zea mays
MAGVSGRGAAERVAAAVEAVGSGGWEFRNAYRRQLLALSRRIRLLGPFVEELREVPCVPAVEPERALAVLADALEEALDLLQLGRDGSRIFLVLDRDKVMKKFHESIVQLEQALCDFSYDKLDISDEVREQVELVHVQLKRAKERVDMPDDEFYNELLSLYNKSHDPSAELDILGRLSEKLHLTTITDLTQESLALHEMVASGGGNDPGEHIEKMSMLLKKIKDFVQTQNPEMGPPMTTKLMDPNGEPRPRNIPDEFRCPISLELMKDPVIVATGQTYERAFIEKWLASGHQTCPNTQQRMPNTTLTPNYVLRSLIAQWCEANGIDPPKRSTQPDKPTSSCSSSERANIDALLSKLCSADPEEQRSAAAELRLLAKRNANNRICIA

SEQ ID NO: 4841 - protein, 574 aa, Panicum virgatum
MKKFQGVIAQLEQALCDFPYDKLDISDEVREQVELVHAQLRRAKERADMPDDEFYNDVLSLYNKSYDPSAELDILERLSEKLHLMTITDLTQESLALHEMVASGGGQDPGEHIEKMSMLLKKIKDFVQTQNPEMGPPIGTKLMDSNGEPRPVNIPDEFRCPISLELMKDPVIVATGQTYERACIEKWLASGHHTCPNTQQRMTNTTLTPNYVLRSLIAQWCEANGIEPPKRSSQPNKPTSACSSSERANIDALLSQLCSHDPEEQRSAAAELRLLAKRNANNRICIAEAGAIPLLLSLLSSSDLRTQEHAVTALLNLSIHEDNKASIISSGAVPSIVHVLKNGSMQARENAAATLFSLSVIDEYKVTIGGTGAIPALVVLLSEGSQRGKKDAAAALFNLCIYQGNKGRAIRAGLVPLIMGLVTNPTGALMDEAMAILSILSSHPEGKAAIGAAEPVPVLVEMIGSGSPRNRENAAAVMLHLCSGEQQRVHLARAQECSIMVPLRELTLNGTERGKRKAVLLLERMSRFLVQQQEEKEAQLLASAQAIPRIPEQVQETDIPEQLDSPSPQYPAVA

SEQ ID NO: 4842 - protein, 673 aa, Panicum virgatum
MAGDGGGAAERAAAAVEAAAAGGWDFRNAYRRQLLALSRRIRLLGPFAEELREARRGPAEKERERALAPLADALEKALDLLRLGRDGSRIFLVLERDNVMKKFQGVIAQLEQALCDFPYDKLDISDEVREQVELVHAQLRRAKERADMPDDEFYNDVLSLYNKSYDPSAELDILERLSEKLHLMTITDLTQESLALHEMVASGGGQDPGEHIEKMSMLLKKIKDFVQTQNPEMGPPIGAKLMDSNGEPRPVNIPEEFRCPISLELMKDPVIVSTGQTYERACIEKWLASGHHTCPNTQQRITNTTLTPNYVLRSLIAQWCEANGIEPPKRSSQPNKPTSACSSSERANIDALLSRLCSHDPEEQRSASAELRLLAKRNANNRICIAEAGAIPLLLSLLSSSDLRTQEHAVTALLNLSIHEYNKASIISSGAVPSIVHVLKNGSMEARENAAATLFSLSVIDEYKVTIGGTGAIPALVVLLSEGSQRGKKDAAAALFNLCIYQGNKGRAIRAGLVPLIMGLVTNPTGALMDEAMAILSILSSHPEGKAAIGAAEPVPVLVEMIGSGSPRNRENAAAVMLHLCSGEQQRVHLARAQECSIMVPLRELTLNGTERGKRKAVLLLERMSRFLVQQQEEKEAQLLASAQAIPRIPEQVQETDIPEQLDSPSPQYPAVA

SEQ ID NO: 4843 - protein, 679 aa, Setaria italica
MAGGGGGGRDRGAAAERVAAAVEAAASGGWEFRNAYRRQLLALSRRIRLLGPFAEELREARGGAAEGEQERALAPLADALGTALDLLRLGRDGSRIFLVLERDNIMKKFQGVIAQLEQALCDFPYSKLDISDEVREQVELVHAQLRRAKERADMPDDEFYNDVLSLYNKSYDPSAELDILKRLSEKLHLMTITDLTQESLALHEMVASGGGQDPGEHIEKMSMLLKKIKDFVQIQNPEMGPPIGTKLMDSNGEPRPANIPDEFRCPISLELMKDPVIVSTGQTYERVCIEKWLASGHHTCPNTQQRMANTTLTPNYVLRSLIAQWCEANGIEPPKRSSQPNKPTSACSSSERANIDALLSQLCSHDPEEQMSAAAELRLLAKRNANNRICIAEAGAIPLLLSLLSSSDLRTQEHAVTALLNLSIHEDNKASIISSGAVPSIVHVLKNGSMGARENAAATLFSLSVIDEYKVTIGGTGAIPALVVLLSEGSQRGKKDAAAALFNLCIYQGNKGRAIRAGLVPLIMGLVTNPTGALMDEAMAILSILSSHPEGKAAIGAAEPVPVLVEMIGSGSPRNRENAAAVMLHLCSGEQQLVHLARAQECGIMVPLRELALNGTERGKRKAVHLLERMSRFLVQQQEEKEAQLLASTQAIPQIPEQVQEIDIPEQLDSPSSQYPTVA

SEQ ID NO: 4844 - protein, 130 aa, Zea mays
MAPSLASTAGLPSCAARRGGRCVARRASAVATPATATARTHYEVLGVGAGASRCEIKAAYRRLAREVHPDCGGRGDEGFIRLHAAYATLADPDERARYDRAAAVRSRIRAAPSGSGAGFRPRRWETDQCW

SEQ ID NO: 4845 - protein, 511 aa, Secale cereale
MSSHEACCGTMFWVYLLSCAGLVMFAGLMSGLTLGLMSLSLVDLEVLAKAGTPQDRRDAARILPVVKNQHLLLCTLLIGNSLAMEALPIFLDSLVPSFGAILISVTLILAFGEIMPQAICTRYGLSMGAKAAPIVRVLLVVFFPVAYPISKLLDWLLGKGHVALMRRAELKTLVDMHGDAAGKGGELTHDETTIIAGALEMTQKTAKDAMTPISETFSLDINAKLDVHTVGMIMTKGHSRIPIYSGRPSNIIGLILVKNLLTCRPEDEVPTRHVTIRKIPRVADDLPLYDILNEFQKGHSHMAVVVKRTKEEGASAEKNNNSFTPDYKMTNGHAQADGLGLSPSHVNIPGGRRNNNDKYSKKIERKRDNILDFNTDPLPHYSMDEEAVGIITMEDVMETLLQEDILDETDEYVDVHNKIKINMLPPGKPLSPLISPSGGPLSQGLRKTPMASPLSPYHNGGSILRSPVANHAQSPGTLPTMLSPGRSPASQTPGRSSPTSSWVSRNSYRNP

SEQ ID NO: 4846 - protein, 511 aa, Secale cereale
MSSHEACCGTMFWVYLLSCAGLVMFAGLMSGLTLGLMSLSLVDLEVLAKAGTPQDRRDAARVLPVVKNQHLLLCTLLIGNSLAMEALPIFLDSLVPSFGAILISVTLILAFGEIMPQAICTRYGLSMGAKAAPIVRVLLVVFFPVAYPISKLLDWLLGKGHVALMRRAELKTLVDMHGDAAGKGGELTHDETTIIAGALEMTQKTAKDAMTPISETFSLDINAKLDVHTVGMIMTKGHSRIPIYSGRPSNIIGLILVKNLLTCRPEDEVPTRHVTIRKIPRVADDLPLYDILNEFQKGHSHMAVVVKRTKEEGASAEKNNNSFTPDYKMTNGHAQADGLGLSPSHVNIPGGRRNNNDKYSKKIERKRDNILDFNTDPLPHYSMDEEAVGIITMEDVMETLLQEDILDETDEYVDVHNKIKINMLPPGKPLSPLISPSGGPLSQGLRKTPMASPMSPYHNGGTILHSPVANHARSPGTLPTMLSPGRSPASQTPGRSSPTSSWVSRNSYRNP

SEQ ID NO: 4847 - protein, 510 aa, Secale cereale
MSSHEACCGTMFWVYLLSCAGLVMFAGLMSGLTLGLMSLSLVDLEVLAKAGTPQDRRDAARILPVVKNQHLLLCTLLIGNSLAMEALPIFLDSLVPSFGAILISVTLILAFGEIMPQAICTRYGLSMGAKAAPIVRVLLVVFFPVAYPISKLLDWLLGKGHVALMRRAELKTLVDMHGDAAGKGGELTHDETTIIAGALEMTQKTAKDAMTPISETFSLDINAKLDVHTVGMIMTKGHSRIPIYSGRPSNIIGLILVKNLLTCRPEDEVPTRHVTIRKIPRVADDLPLYDILNEFQKGHSHMAVVVKRTKEEGATAEKNNSFTPDYKMANGHAHADGLGLSPSHVNIPGGRRNNNDKYSKKIERKRDNILDFNTDPLPHYSMDEEAVGIITMEDVMETLLQEDILDETDEYVDVHNKIKINMLPPGKPLSPLISPSAGPLSQGLRKTPMASPMSPYHNGGTILHSPVANHARSPGTLPTMLSPGRSPASQTPGRSSPTSSWVSRNSYRNP

SEQ ID NO: 4848 - protein, 510 aa, Hordeum vulgare
MTSHEACCGTMFWVYLLSCAGLVMFAGLMSGLTLGLMSLSLVDLEVLAKAGTPQDRRNAARILPVVKNQHLLLCTLLIGNSLAMEALPIFLDSLVPSFGAILISVTLILAFGEIMPQAICTRYGLSMGAKAAPIVRVLLVVFFPVAYPISKLLDWLLGKGHVALMRRAELKTLVDMHGDAAGKGGELTHDETTIIAGALEMTQKTAKDAMTPISETFSLDINAKLDVHTVGMIMTKGHSRIPIYSGRPSNIIGLILVKNLLTCRPEDEVPTRHVTIRKIPRVADDLPLYDILNEFQKGHSHMAVVVKRTKEAGASAEKNSSSTPDYKMTNGYAHADGLGLSPSHVNIPGSRRNNNAKYSKKIERKRDNILDFNTDPLPHYSMDEEAVGIITMEDVMEELLQEDILDETDEYVDVHNKIKINMLPPGKSVSPLVSPGGEPPSQGIRKTPMASPLSPYHNGGSILRSPVTNQTRSPGTLPTAFSPGRSPASQTPVRSSPTSSWVSRNSYRNP

SEQ ID NO: 4849 - protein, 238 aa, Secale cereale
MSGSRSASCRSASSTWRCWPRPARRRTGATPPGSCPSSRTSTCSSARSSSATSLAMEALPIFLDSLVPSFGAILILRHPHSSPSVRSCRRPSARAYGLSSGGQGGAHRPVLLVVFFPVALPISKLLDWLRGKGHVALMRRAELKTLVDMHGDAAGKGGELTHDETTIIAGALEMTQKTAKDAMTPISETFSLDINAKLDVHTVGMIMTKGHSRIPIYSGRPSNIIGLILGKKLAYLPT

SEQ ID NO: 4850 - protein, 478 aa, Triticum aestivum
TLGLMSLSLVDLEVLAKAGTPQDRRNAARILPVVKNQHLLLCTLLIGNSLAMEALPIFLDSLVPSFGAILISVTLILAFGEIMPQAICTRYGLSMGAKAAPIVRVLLVVFFPVAYPISKLLDWLLGKGHVALMRRAELKTLVDMHGDAAGKGGELTHDETTIIAGALEMTQKSAKDAMTPISETFSLDINAKLDVHTVGMIMTKGHSRIPIYSGRPSNIIGLILVKNLLTCRPEDEVPTRHVTIRKIPRVADDLPLYDILNEFQKGHSHMAVVVKRTKEDGASAEKNNSFTPDYKMTNGHAHADGLGLSPSHVNISGSRRNNNDKYSKKIERKRDNILDFNTDPLPHYSMDEEAVGIITMEDVMEQLLQEDILDETDEYVDVHNKIKINMLPPGKSLSPLISPSGGPLSQGLRKTPMASPLSPYHNGGSILRSPVTNHARSPGTLPTMFSPGRSPASQTPVRGSPTSSWVSRNSYRNP

SEQ ID NO: 4851 - protein, 513 aa, Brachypodium distachyon
MSSHQECCGTMFWMYLAFCVLLVLFAGLMSGLTLGLMSLSLVDLEVLEKAGTPQDRLNAARILPVVRNQHLLLCTLLIGNSLAMEALPIFLDSLVPSFGAVLISVTLILAFGEIMPQAICTRYGLRMGAKAAPVVRVLLVVFFPVAYPISKLLDWLLGKGHFALMRRAELKTLVDMHGDAAGKGGELTHDETTIITGALEMTQKTAKDAMTPISETFSLDINAKLDRHTVGMIMTKGHSRIPIYSGRPSNIIGLILVKNLLTCRPEDEVPTRQVTIRKIPRVADDLPLYDILNEFQKGHSHMAVVVKRSKEAGASAEKINGAAADYKINHKHVHADGLSPSHVDIPGSRRNNLEKGDLRSHSKKFERKRDNILDFNTDPLPSYSMDEEAVGIITMEDVMEQLLQEDIFDETDEYVDVHNKIKINMLPPGKSLSPLISPSGGPLSQGLRKTPMASPLSPYRNGGSILRSPVSNHAQSPGIYSTTISPGRSPMSQTTVSSSPTSSWVSRNSYRRT

SEQ ID NO: 4852 - protein, 473 aa, Pennisetum glaucum
KQSQGGLFGWLLGGKSSQLPPLDVPLPGITIPPPLPDFVEPSKTKITTLPNGIKIASETSASPAVSVGLYIDCGSIYETPASSGVSHLLERIAFKSTMNRSHLRLVREVEAIGGNVSASASREQMSYTYDALKSYTPEMVEVLIDSVRNPAFLDWEVKEQLQKIKSEIAEVSANPQGLLLEALHSAGYSGALAKPLMASESAVNRLDVSVLEEFVSEHYTAPRMVLAASGVEHDTLVSVVEPLLSDLPSAKRPEEPKSVYVGGDYRCQADSPSTHIALAFEVTGGWNQEKTAMVVTVLQMLMGGGGSFSAGGPGKGMHSRLYLHILTNYPQIESFSAFNSVYNNSGLFGIYAVTSPDFSSKAVDLAAGELLEIATPGKVSQEQLDRAKEATKSAVLMNLESRSIASEDIGRQVLTYGERKPIEYFLKTVEEITLNDISSTAKKMMSSPLTMASWGDVIHVPSYESVSRKFHSK

SEQ ID NO: 4853 - protein, 520 aa, Setaria italica
MPSHEACCGTMFWVYLTACVGLVLFAGLMSGLTLGLMSLSLVDLEVLAKAGKPKDKLNAERILPVVKNQHLLLCTLLIGNSLAMEALPIFLDTLVPSYVAILISVTLILAFGEIMPQAICTRYGLSVGAKAAPVVRILLILFFPVAYPISKLLDWLLGKGHFALMRRAELKTLVDMHGNEAGKGGELTHDETTIITGALELTQKIAKDAMTSISETFSLDINAKLDLHTMGMIMTRGHSRVPIYSGSPSNIIGLILVKNLITCRTEDEVPIRNVTIRKIPRVNDDLPLYDILNEFQKGHSHMAVVVKRTKEAGASNGKQKSTTADYKINPKDAHSDGSSPSYVSTAGSRRYNIEKYGDGRSYNKKSERKRENILDFNTDPLPSYSMDEEAVGIITMEDVMEELLQEEIYDETDEYVDVHNKIRINMLPPGKSLSPAISPGGGPLSHGLRKTPMASPLSPYNHGSSFLRSPVSNHGQSPGILPTILSPGRSPASQTPGQSSPNSSQDSRNSNGKHKKDIES

SEQ ID NO: 4854 - protein, 511 aa, Panicum virgatum
MPSHEACCGTMFWVFLTACVGLVMFAGLMSGLTLGLMSLSLVDLEVLAKAGTPKDRLNAARILPVVKNQHLLLCTLLIGNSLAMEALPIFLDTLVPSFVAVLISVTLILAFGEIMPQAICTRYGLSVGAKAAPVVRILLILFFPVAYPISKLLDWLLGKGHFALMRRAELKTLVDMHGNEAGKGGELTHDETTIITGALELTQKIAKDAMTPISETFSLDINAKLDLYTMGMIMTRGHSRVPIYSGSPSNIIGLILVKNLITCRAEDEVPIRNVTIRKIPRVADDLPLYDILNEFQKGHSHMAVVVKRTKEAGPSTEKQKSTTADYKINPKDAHADGSSSSYVSTAGSRRNNIEKYGDGRSYNKKSERKRENILDFNTDPLPSYSMDEEAVGIITMEDVMEELLQEEIYDETDEYVDVHNKIKINMLPPGKSLSPAISPGGGTLSQGLRKTPMASPLSPYNHGSSVFRSPVRNHGQSPGTLPTILSPRQSSPNSSQDSRNSNGKHKKAGES

SEQ ID NO: 4855 - protein, 511 aa, Panicum virgatum
MPSHEPCCGTMFWVFLTACVGLVMFAGLMSGLTLGLMSLSLVDLEVLAKAGTPKDKLNAARILPVVKNQHLLLCTLLIGNSLAMEALPIFLDTLVPSFVAVLISVTLILAFGEIMPQAICTRYGLSVGAKAAPVVRILLILFFPVAYPISKLLDRLLGKGHFALMRRAELKTLVDMHGNEAGKGGELTHDETTIITGALELTQKIAKDAMTPISETFSLDINAKLDLHTMGTIMTRGHSRVPIYSGSPSNIIGLILVKNLITCRTEDEVPIRNVTIRKIPRVADDLPLYDILNEFQKGHSHMAVVVKQTKEAGASTEKQKSTAADYKINPKDAHADGSSPSYVSTAGIRRNNIEKYGDGRSYNKKSERKRENILDFNTDPLPSYSMDEEAIGIITMEDVMEELLQEEIFDETDEYVDVHNKIRINMLPPVKSLSPAISPGGGPLSQGLRKTPMASPRSPYNHGSSVFRSPVWNHGQSPGTLPTILSPGQSSPNSSQDSRNSNGKQKKDGES

SEQ ID NO: 4856 - DNA, 2000 bp, Wheat SPA Promoter
ttttctcttgcgagagccgctcacctcaaggccccccgccattcctgctgtgaactatagccagcggctggggatgatacaagcaggggcaaccaacgaccaccggagttgccacggttgtcactgatgttgcggtggcgccaccatgaagaccatgtccatgcggtggttggtgcagtttccagcggtgctacaaccgcggaacactaatgctgcaaccggtagcaggagctgttgcgaccgacgacgaaatttgctgccttgaggctgatggtaatggacaagacgagggcggacgccttggtgctacaaccagcatccggtgttgccggaacgacaaccgccatttgctgcaaccggcaatcatgcaacacagagaggaagataccgcgtgctgggatcggccgtcaccctgggcgcgacaaaaagctgcaaccattcgttggtaaagcttcaacctcctgatgaatttcctggaaccagtattcaattttgcttgaactggataattttttgctacaatcgatcaacgagagttcttgctggtaagttgtttttgctagaaccggtgttcaattttgctagaactatattttgctacaatcgatcaccccgagagttcttcttgatgagttgttttgctcgaaccagtattcaattctgctggaactgagtaattttttgcttcaaccaacaaatggtggatttgctgctttccaagttttttgttgggcacgactgtgcaagtcaacgatcgcggcggcgccgatggtgctccaaccatggtgaacgcgcgatggaaccagccgggccggagctgcaatggcctggttcccgagctatggacgcggcgtgcggtgactgcaagcttcagcagaagggtggcagggggctggatgatggtgctgcaaccagtagcggtgcaaggggacggggtgctgccgcccctcgatggagcgcacatgcatgggaccgagagcagagatgctcacggggaacaggaaggaggggatttcctgctcacgttgaccaaagcgagaggaaggagatgattcggtgaccgactacaaatcatcatatcaaacaattgggggccgaccggccaaaacgttcggtcggcgtgctagtggctaataatggcctaccggtatggaccacgttagtcaaatggtaagcgacgcatgtatataaggtatattaatgcgaccaactcgcaaggtccgtcacctatattcggagaacatatttctgtaatatataaatttaataggtaaagtcacatttatcattctcaaaagagggtggcccgtgtgaggaactcgtcctgagcaaagacgaggaggtttccactcaaccgttgtcactctagctatagtgtatattagaagttaagtgtttccgttaccttttcatatacaacaacaatttaaagttagaaaccctgtaaatcacatggaagcgtatggatcgcaacgagtcaaaataaacatggcgcattagtgacacgtattttaaactttctgttaacactttttgttctttcattaaaggatatttgtttgcattagcgttgtcatgctagacgagcacatacattacaacattattatgtgtttgttgtggtttctagagacaagacatgaacacctaaataaagaggacatggacgaaaaggttaaccgtaatagctcatgcaagatgacaagcaaaacatttcattgtatgaggttccgtggatcacacttctctatgtactctcagaaacgaaaacacttgtctagacgatggtagaccgtcggaataggtgaacatcttttgtacaacagaaagtatgactaacgtggcgccgcggccgaaactgcattatcagttcagctgaatttgtactgtatgtcatatctatctcgagtattcaagacagaaaaaccttgtgcagtagtagtactactgaaataaaatagacatgagaggatcgcaccctcaacccatctcattcagca

SEQ ID NO: 4857 - DNA, 1919 bp, Wheat LMW Longer Promoter
  misc_feature (1306)..(1316): n is a, c, g, or t
  misc_feature (1649)..(1649): n is a, c, g, or t
tatcatgatgacatttctatgtgctaaagattcttctacaaagccggttcaaatacaaaacaaatatgccaaaaaactacttaaattaccagtagcgagtgtacaaaagttagcagcagcgcctcaatagcagtagagcgtccggccaaagagcgctagcgctactagcggtagcgagcttctcataaccgcgctgctgctacacttgtgtagcagtagcgcgggtgctcacgcgttactgctatgagttagctgtagcgccgtattagtagcgcgggtacccgcactactgatacatctaaaacccgcgctgctgctagccttttccctagtagtgctagtcgatgtatctccccacaacctcacctctacaccggactacaaggaagtcttctgacggcgggaattgccgaagcacgcttgaccccacttgttcctcgccggacaaaagacatctagcgcggcataattcaaacgccacgctggaaccaatagtcgtagcggggcggtcaggaactgcgtcatctcgcttattaggcatgcttttcatatttttacttgcgaccctacagcacggttccgtgtcaatatcatagacttctagttgtggagttttgttttttcgtcgtcgacatgagaaatatatggtccacctgcttagcgcgcatagggggaaatttgatgattattggaacttttgaagtgaaattctcagaaagcacatagttatattcagctactaaagccacaaatgtacattactgtcaggcttcccagctgaattctgatgcctgaccctcctaatccgtgcagctagcatggagatgggtctgcctctcggatttatgtgcattgaatcgttggaagagacagacgaaacaaatcgataccttgtgttgatggggaggtcggagtggctgccgtcgacgtacggcccacaatcgacggaggagcttcaaaagtgaccttttttgtcgagcggtggtggtggtggtggggggccggatgttgagggtgggagggaggctgacgtctccgctgccgcggaggtacgtggaggggccgcgagcggtgggcgtccgggagaggctgcgacggcgagcggtccggccggcgaggaggacgaggaagggagggacgcagatccgcggagtgtgggctgggcttgtgtcgttggggcctacgagaactatagcccaaatcgaattggtgccctaacacacggcacttatgttgggcctaatctctcgctccaggctgggggcctctgttccagccccatctatcatttccccctagcgtcatnnnnnnnnnnnaaaaaaatccccctagcataaaaaaactatcatttcccccaaaaaaacccttcacaaatagatgaaactgatgatttatctaaaaaaataggcgaaactgatgatgacgtgtcaagagttaggaccggatatatgctagtaggagtagcttgtaagcaattaccatcctttacatgtaaagggaattcgatgagtcatgtcatgctctataggcgtcggttcatctaatcattttagaggaaaaatacaaagttagttctacacttagtcctacacaagttttgcctttcttgtttatggatgacagcctatacaaggttccaaactcggttnacaaggttccaaactcggttgcaaaagtgatactatccagataagtgtgtgacatgtaaagtgaataaggtgagtcatatataccaaacatcaaggtttctgtactttatgtgtgatcatatgcacaactaaaaagcaactttgatgatcaatccaaaagtacgcgtgtagctagtgcaacctaacacattgtaccaaaaatcattttagatgcatccaaacagaattattaaagctaatgcaaagaagaaaagaggtggtgcccgggct

SEQ ID NO: 4858 - DNA, 326 bp, Wheat LMW Promoter
  misc_feature (56)..(56): n is a, c, g, or t
agttttgcctttcttgtttatggatgacagcctatacaaggttccaaactcggttnacaaggttccaaactcggttgcaaaagtgatactatccagataagtgtgtgacatgtaaagtgaataaggtgagtcatatataccaaacatcaaggtttctgtactttatgtgtgatcatatgcacaactaaaaagcaactttgatgatcaatccaaaagtacgcgtgtagctagtgcaacctaacacattgtaccaaaaatcattttagatgcatccaaacagaattattaaagctaatgcaaagaagaaaagaggtggtgcccgggct

SEQ ID NO: 4859 - DNA, 2000 bp, Wheat HMW glutenin-1 longer Promoter
cctaccattagaagaacgtccggcaaagagatgcactgcaacatatgaccaaaacgtcatccatgatcgagtacaatttcttagtgcctttttcatcaaagttatatttgaaacattttagaaaatttgtcttaaattttttcccatggcgtttcgatcaaaaaaatgccttaaaacctacctatataaaggcaataagggaaaacacttcaggataccttcgaatctaaggtgtctttctttagatggtatgctaaactgttcttcatggcgcctcaaatcatcattctgcaagtaaagactaaaaataacgctaaatatggagttaaaggtttacaaacgacgagcggaaaaggagtcttatataattccagtagcatttattccattttgcttcacatagaaaatgtagctgaggtggtcgatgtttattttgactcgcgtgaggtcgccggttcgatctcagaagcaacgctggaatatcccatatagatttatttttcaggctgagtgatgctcgggtacctccagcgtatgggctgaaattcgccccccctgcaaatcatgggccctgtgacgttcgcacgggttgcacatgccttggcccgggcctactaggagtgtacctggattatgttggacgacgggagatgaaagggatgtattaattaacaaagataatgaagcttaattttcttatatgttgttaatattgacaagaaacaagctgctaactcaaagttacggttacatagtcgcaaccttttatatctaaataatatctctctctcaacatgcaaacatgccacctcagcatgtagcatgcatggaaattgtccacttcaacatgcaaccatgcatcaaaatttccattttactaggctatttatttgataaaatttcacaaatatacaataatcaaacacaatagatcatatgtgttttcagttttggttctcacattattactccaaatataaatgtttcgtataaccaaatttcattcaaatatactgcaaaacatttccgtgaaaacatgtggggtacatctagttataaggaaatattagtgatgtcctgcaagtgataaggccaaggagagaagaagtgcaccatctacagaggccagggaaagacaatggacatgcagagaggcgggggcggggaagaaacacatggagatcatagaagaacataagaggttaaacataggaggaggatataatggacaattaaatccacattacctgaactcatttgggaagtggaaaaatcccctattctggtgtaaatcaaactaattgacgcgagttttctctgaagattctatgttaattttagacatgaatgaccaaaggtttcagttagttgagttttgtcatcgaaaggtgtttacataagtccaaaaattctaccagcttttggtacggcgcgtcatagaacagataaatgttgtgagtcattggatagatattatgagtcatagcatggatttgtgttgcctggaaatctaactatgacaagaaacaaaacataaatgggcttttgaaagatgatttatcaacttaccttatccatgcaagctaccttccactagtcgacatgcttagaagcttttagtgaccgcagatttgcaaaagcaatggctaacagacacccaaaccccaagaagcataaccacttctcttagataaaaatagcagatcgatatacaaacgtctacacttctgcaaacaatacccagaagccagaattaggattgaaccgattacgtggctttagcagaccgtccaaaaatctgttttgcaaagctccaattgctccttgcttatccagcttcttttgtgttggcaattgttcttttccaaccgactttattcttttcacatttcttcttaggctgaactaacctcgtcgtgcacacaaccattgtcctgaaccttcaccacgtccctataaaagcccaaccaatctccacaatttcatcatcacccacaaca

SEQ ID NO: 4860 - DNA, 425 bp, Wheat HMW glutenin-1 Promoter
catgcaagctaccttccactagtcgacatgcttagaagcttttagtgaccgcagatttgcaaaagcaatggctaacagacacccaaaccccaagaagcataaccacttctcttagataaaaatagcagatcgatatacaaacgtctacacttctgcaaacaatacccagaagccagaattaggattgaaccgattacgtggctttagcagaccgtccaaaaatctgttttgcaaagctccaattgctccttgcttatccagcttcttttgtgttggcaattgttcttttccaaccgactttattcttttcacatttcttcttaggctgaactaacctcgtcgtgcacacaaccattgtcctgaaccttcaccacgtccctataaaagcccaaccaatctccacaatttcatcatcacccacaaca

SEQ ID NO: 4861 - DNA, 595 bp, wheat alpha gliadin (B genome) Promoter
tcaagcttgtctagttacagtaacaacttgtggaacattacaaaatttatgtttgctagtaacttctagaacactacaacacttgacatgtataaggaatttgatgagtcatggcctactaaagcaagttatattactactcttatctatcttaacaggtcacacaagattacaaactaagttctgtatcagccatgcttatctagtttatgcataacaatttgcagaacattacaaacttagtttcggaaaaataggcaatctagattagtgtttgagctataaagtgaataagatgagtcatgcgtgttatcacacctctttggtggtggaatgatagtgcaacaacatgaaacttcagtgactagtccaagaatacacatgtaagtagtgccaccaaacacaacataccaaattatgattttgggaagcatccaagcactttccagacaagaaaatgccaattgtgaaagagatcataccatgggaactataaaaagccttgtagcatgatcatcatccttcctcacccatcattctcataagtagagcgcatcattcaagccaagcaagcagtggtcaatacaaatccacc

SEQ ID NO: 4862 - DNA, 1238 bp, wheat gamma gliadin Promoter
  misc_feature (1231)..(1231): n is a, c, g, or t
atacttatatagggtagcgatattcacttgggaggtcggggttgtgctcggggaagcaggggcttgccggacgcaaggctcggacggcctccacgcctctgttccgtgaacagaggagatgggatcctccaagtgggcggggccacaatagtttatagtaggcccatgtgcacagcaggtcttccatattttccctttttatctcctgtaatatttccaccactctattgcatttagtttatgcagcaaacgacttttgctataactgaaacttggcacataaatcaagcacacaattttggggtggcacaaaaagtttggggccaaattgaaatcacttaaattataattgcatttaaaagagctaaaagggtgtcgttggtccacagtttaatattcataggcattttaaaagtttccagaaaaaactttgctaatgtatgacagttatgtagtgaatattttcaacctaaggaacatttttaatttattttttataaaattataattcgacttggcattcgaatttggatttgagttttggtttgaaacggaaagaggattagtaaaatgattatgatgacatagcatcattaggcatgagattactgtagcatgacatcgggggtgttacacttgtacaatattcctacccttgacataaaaggagaatttgatgagtcatgtattgataacgtatacaacattactacccttgacataaaaggagaatttgatgagtcatgcattgataacatgtacaagattactatcagcttgttcatcttaccatcatattatacaacactacaagttagttttagaaagaacaagagtccacaacaaatatcagaatacttgcctgatctatcttaacaacatgcacaaggacacaaatttagtcccccgcaagctatgaagatttggtttatgtctaacaacttgtacagatccaaaaggaatgcaatccagataattgtttgacatgtaaagtgaataagatgagtcaatgccaattatcagtattcctcactcttagatgatatgtacaataaaaagacaactttgatgatcactctgaaattacgtttgtatgtagtgccaccaaacacaacataccaaataattagtttgataagcatcaaatcacttttaaaaaagaaagcaataatgaaaagaaacctaaccatggtagctataaaaaggcctacaatatgtagactccataccnactccat

SEQ ID NO: 4863 - DNA, 2162 bp, wheat TdPR60 longer Promoter
agaagaagaaggagcaccaatacaatggagtttcacccggcttcacagccctgttacttttcccagagccccaaaaactctcctcaacaaatacactcgtggtcatggctttgtaggggcacaacaacgcagcgcccacgtttccttgtgcgcatgtacgcacgccgcctagctagcaaccctgcatgcaatcccatcagcccggccatgcgcactacatgcgcgctacgcacacgacgcggccatctccaccggtcactgctaacaatcatctaactaactcacacgcatcaagcaaacttggccggcacacttgccaacgccctgctctacgtgccagactcgagagtatacacgctacacacacatgcgccacgcttctgcgtcccgtacgtcccgcccgtcccgcatgtcatcgacgcgcccgtcaagcccgacgagcccgacggcaccagtgtgtcccgcctgtcccacgcgcacccgacgcgcccgacgagcccgatcacacatgtcgtggcttattccaaaacacaccccttaagccacggcctagaggagtccgtcatcgtcgacgttggcgccggctaagagtgcatgctccgccgccggtcctttccgcagctgcgggcactcgcgccggaagtgcccgtgctccccgtacttgtagcagcgcctgcgcctgtcgccgccgctccccgacgccacgctgcgcccgtcgtcgtcgtcccgagcaccgccgtgtcgacgctcccatgctgcccactgcgccaccgtcatgagcagctgctcacctccgcgctcgccgccgtcttgtccacagcgccgaacccgctcgtcgaacgcacgcagccgcccgagcgcttcgtcgaacgccatcgtcgtcacgtcgtggaactgctcgataccggcgacgacggggaagaggcgatccgacaccgtatcccagcaacttcttgacaagtgccgtgtcgcccagtgtctccccgaggttggcatacctcgccgccatcgccgcgagcctcccgccgtacacgtcgagctcctcgccgtccaccatcttcatccggtcgaatttgccatgcagcgtccccggcctcgctgcgcgtacccgatcagcgcggacgaacctcaccttcagggagtcccatacctccctgacggtgagcttcgtcgataccagcagcagcacatcctccggcaacgccccgagaagcaacgtgcgcaccatcttgtccttccgcgcgttcaccaccgcgtcgcccggcgccaccgcctcccatacggtgtggacgtcgaggatcgcctacgccttgatggcccagaccgtgtagttgtccgcggtcagcaaaggcatcgccatcgtcgccgattccgcccgcgccgccgccgtgtgggacgggcgccatggtcgccggtgatcgcccgaaccaaagctctgtatatcaattgttggaagcgctctctcacactgatggatggagatagaagaagaaggagcacacagtacaatggagtttcacccggcttcacagccctgttacttttcccagagccccaaaaactctcctcaacaaatacactcgtggtcatggctttgtagtggcacaacaacacaacgcccacgtttccttgtgcgcacgtatgcacaccgcctagctagctaccctgcatgcaatccatcagcccggccatgcgcactacatgcgcgctatgcgcatgacgcggccatctccaccggtcactgctaacaatcagctaactaactcacacgcatcaagcaaacttggccggcacacttgccaacgccctgctctatgtgctagactcgagtgtatacacgctacacacacatatgccacgcttctgcgtcccgcatgtcccgcacgtcaccgacgcgcctgacaagcccgacgagcccgacggcaccagtgtgtgccgcccgttccgcgtgcacccgatgcgctcgacgagcccgatcacacacgccgtggcttattccaacacctagatgtataattaatgtatacattaattgtctgacacggtgctatatcttcatgatatacaactggtgtatgcgtctgtatcatcatctcaaagaaggctatatataccaagacatagctagcgaagtcatgtatcccacacattcacagaagcca

SEQ ID NO: 4864 - DNA, 2147 bp, wheat TdPR60 Promoter
accaatacaatggagtttcacccggcttcacagccctgttacttttcccagagccccaaaaactctcctcaacaaatacactcgtggtcatggctttgtaggggcacaacaacgcagcgcccacgtttccttgtgcgcatgtacgcacgccgcctagctagcaaccctgcatgcaatcccatcagcccggccatgcgcactacatgcgcgctacgcacacgacgcggccatctccaccggtcactgctaacaatcatctaactaactcacacgcatcaagcaaacttggccggcacacttgccaacgccctgctctacgtgccagactcgagagtatacacgctacacacacatgcgccacgcttctgcgtcccgtacgtcccgcccgtcccgcatgtcatcgacgcgcccgtcaagcccgacgagcccgacggcaccagtgtgtcccgcctgtcccacgcgcacccgacgcgcccgacgagcccgatcacacatgtcgtggcttattccaaaacacaccccttaagccacggcctagaggagtccgtcatcgtcgacgttggcgccggctaagagtgcatgctccgccgccggtcctttccgcagctgcgggcactcgcgccggaagtgcccgtgctccccgtacttgtagcagcgcctgcgcctgtcgccgccgctccccgacgccacgctgcgcccgtcgtcgtcgtcccgagcaccgccgtgtcgacgctcccatgctgcccactgcgccaccgtcatgagcagctgctcacctccgcgctcgccgccgtcttgtccacagcgccgaacccgctcgtcgaacgcacgcagccgcccgagcgcttcgtcgaacgccatcgtcgtcacgtcgtggaactgctcgataccggcgacgacggggaagaggcgatccgacaccgtatcccagcaacttcttgacaagtgccgtgtcgcccagtgtctccccgaggttggcatacctcgccgccatcgccgcgagcctcccgccgtacacgtcgagctcctcgccgtccaccatcttcatccggtcgaatttgccatgcagcgtccccggcctcgctgcgcgtacccgatcagcgcggacgaacctcaccttcagggagtcccatacctccctgacggtgagcttcgtcgataccagcagcagcacatcctccggcaacgccccgagaagcaacgtgcgcaccatcttgtccttccgcgcgttcaccaccgcgtcgcccggcgccaccgcctcccatacggtgtggacgtcgaggatcgcctacgccttgatggcccagaccgtgtagttgtccgcggtcagcaaaggcatcgccatcgtcgccgattccgcccgcgccgccgccgtgtgggacgggcgccatggtcgccggtgatcgcccgaaccaaagctctgtatatcaattgttggaagcgctctctcacactgatggatggagatagaagaagaaggagcacacagtacaatggagtttcacccggcttcacagccctgttacttttcccagagccccaaaaactctcctcaacaaatacactcgtggtcatggctttgtagtggcacaacaacacaacgcccacgtttccttgtgcgcacgtatgcacaccgcctagctagctaccctgcatgcaatccatcagcccggccatgcgcactacatgcgcgctatgcgcatgacgcggccatctccaccggtcactgctaacaatcagctaactaactcacacgcatcaagcaaacttggccggcacacttgccaacgccctgctctatgtgctagactcgagtgtatacacgctacacacacatatgccacgcttctgcgtcccgcatgtcccgcacgtcaccgacgcgcctgacaagcccgacgagcccgacggcaccagtgtgtgccgcccgttccgcgtgcacccgatgcgctcgacgagcccgatcacacacgccgtggcttattccaacacctagatgtataattaatgtatacattaattgtctgacacggtgctatatcttcatgatatacaactggtgtatgcgtctgtatcatcatctcaaagaaggctatatataccaagacatagctagcgaagtcatgtatcccacacattcacagaagcca

SEQ ID NO: 4865 - DNA, 1992 bp, maize Ub1 Promoter (cultivar Nongda 105)
tctgcagtgcagcgtgacccggtcgtgcccctctctagagataatgagcattgcatgcctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgaccaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgaggcggcacggcaggcggcctcctcctcctctcacggcacggcagcctacgggggattcctttcccaccgctccttcgctttcccttcctcgcccgccgtaataaatagacaccccctccacaccctctttccccaacctcgtgttcgttcggagcgcacacacacacaaccagatctcccccaaatccacccgtcggcacctccgcttcaaggtacgccgctcatcctccccccccccctctctctaccttctctagatcggcgttccggtccatggttagggcccggtagttctacttctgttcatgtttgtgttagatccgtgtttgtgttagatccgtgctgctagcgttcgtacacggatgcgacctgtacatcagacatgttctgattgctaacttgccagtgtttctctttgaggaatcctgggatggctctagccgttccgcagacgggatcgatttcatgatttttttttgtttcgttgcatagggtttggtttgcccttttcctttatttcaatatatgccgtgcacttgtttgtcgggtcatcttttcatgttttttttggcttggttgtgatgatgtggtctggttgggcggtcgttctagatcggagtagaatactgtttcaaactacctggtggatttattaaagatctgtatgtatgtgccatacatcttcatagttacgagtttaagatgatggatggaaatatcgatctaggataggtatacatgttgatgcgggttttactgatgcatatacagagatgctttttttttcgcttggttgtgatgatgtggtctggttgggcggtcgttctagatcggagtagaatactgtttcaaactaactggtggatttattaattttggatctgtatgtgtgtgccatacatcttcatagttacgagtttaagatgatggatggaagtatcgatctaggataggtatacatgttgatgttggttttactgatgcatatacatgatggcatatgcagcatctattcattcatatgctctaaccttgagtacctatctattataataaacaagtatgttttataattattttgatcttgatatacttggatgatggcatatgcagcagctatatgtggattttttttagctctgccttcatacgctatttatttgcttggtactgtttcttttgtcgatgctcaccctgttgtttggtgttacttctgcag

SEQ ID NO: 4866 - DNA, 1358 bp, Ub1 Promoter (cultivar B73)
gtgcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaaatctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttc

SEQ ID NO: 4867 - DNA, 1266 bp, rice actin 1 Promoter
tagctagcatactcgaggtcattcatatgcttgagaagagagtcgggatagtccaaaataaaacaaaggtaagattacctggtcaaaagtgaaaacatcagttaaaaggtggtataagtaaaatatcggtaataaaaggtggcccaaagtgaaatttactcttttctactattataaaaattgaggatgttttgtcggtactttgatacgtcatttttgtatgaattggtttttaagtttattcgcgatttggaaatgcatatctgtatttgagtcggtttttaagttcgttgcttttgtaaatacagagggatttgtataagaaatatctttaaaaaacccatatgctaatttgacataatttttgagaaaaatatatattcaggcgaattccacaatgaacaataataagattaaaatagcttgcccccgttgcagcgatgggtattttttctagtaaaataaaagataaacttagactcaaaacatttacaaaaacaacccctaaagtcctaaagcccaaagtgctatgcacgatccatagcaagcccagcccaacccaacccaacccaacccaccccagtgcagccaactggcaaatagtctccacccccggcactatcaccgtgagttgtccgcaccaccgcacgtctcgcagccaaaaaaaaaaaaagaaagaaaaaaaagaaaaagaaaaacagcaggtgggtccgggtcgtgggggccggaaaagcgaggaggatcgcgagcagcgacgaggcccggccctccctccgcttccaaagaaacgccccccatcgccactatatacatacccccccctctcctcccatccccccaaccctaccaccaccaccaccaccacctcctcccccctcgctgccggacgacgagctcctcccccctccccctccgccgccgccggtaaccaccccgcccctctcctctttctttctccgttttttttttcgtctcggtctcgatctttggccttggtagtttgggtgggcgagagcggcttcgtcgcccagatcggtgcgcgggaggggcgggatctcgcggctggcgtctccgggcgtgagtcggcccggatcctcgcggggaatggggctctcggatgtagatcttctttctttcttctttttgtggtagaatttgaatccctcagcattgttcatcggtagtttttcttttcatgatttgtgacaaatgcagcctcgtgcggagcttttttgtaggtagaagatggctgacgccgaggatatc

SEQ ID NO: 4868 - DNA, 2199 bp, rice GOS2 longer Promoter
tctagaatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctcctcctcccatctataaattcctccccccttttcccctctctatataggaggcatccaagccaagaagagggagagcaccaaggacacgcgactagcagaagccgagcgaccgccttcttcgatccatatcttccggtcgagttcttggtcgatctcttccctcctccacctcctcctcacagggtatgtgcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatcgattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagtttc

SEQ ID NO: 4869 - DNA, 1024 bp, rice GOS2 Promoter
ggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatcgattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagtttc

SEQ ID NO: 4870 - DNA, 2103 bp, arabidopsis Pho1 Promoter
actgtttaaggacaaaaaatgtggaactgatgtctcctaggtggtggaatatgtgaagctagaaaacaaataaatgcggtccgactcagaccatcattttcctcttgtctcattggttttaaaattaaatattatattataaaatctgttgcagtattttttttaatctcaattagagttatttatttaggtctcaacccatggtggggaaaaaaacagctattttaggtaaatttagattacaaaattgtatagtcaatatcaataataggttaaagttttaataaactgggtgaatcagtttttgtttggtcttcttggatctttgtttggtctcaatattttggattacatataaattccatcccgactattatttgggttttgccgctggactctataacacactgattttagttttatatgaattttacgttgttttacgtttgatcatgaactaaaaattcagcaatccataagaaaatattttttggactagttcgaaactcggccagacaatactaaacctattcacatatttaactttttttttttttggacaaacataattaactttagtaagtgttatatttttgtcaatattaaactagatgtggtgtttttaattgtgggaaataaaattaaagaagcaaagttccatgaaatatggactttccgtaattggaaggccgccatatgttgccttcatttgtattttccttttattgacccttttgttttcttataagataaatatatatataactaattaggcagaagctgagtggcattagttagtgaaatatatttatcattatcccaaattcctctagctgacattactttgaatttagaaatttcttatccgcaaaatttgtactaatattatgaagtagtacatcgaatagaatatatattggtgcacattatgatccactttcaatgccatccattcgaatggttgctcagaacgtacttgtagaaaccgcgtgcataaagtttcatatgagcatcgtgtgctttgttatttaattttttcttccctaaataatcagacagaaaaattcataaacttctttaataaaaccatccaaaaggggattatactacgaaaattatggcatctaaacgcaaagtttaatatatttttagtaccaatgcattgtaaaagaatggaaattaaataaaaacaatatgaaactgtttgttcccttggacaaaaaaaaaacttggtatgactatgatttttatatgcgcttttgtaattgcattgtaattttgtcgatatggaagtggattttaaagaacattaatccatgatctgataggtgaaaactcacactacttgactgctatataacatggtttggtagtatctgcatttgtaatgtgaaactatgaaatcagaatttgattggtaattcttcttctgcttcttttttcttgattctttaagatttagtatgtgtttcaaatttttcattgtcctccgaaaaaatgtagtggaaatcgagctggtccaatctaagttcactcaccttttgtgtctcttggcacctaatttctttttggtccatttcagctatcttcttccttttccacacaaaacattacaaaatacttactatttctagttctccgatttacaatacccaaattacccttacccttgcccctcatatagttcgtataacaactttcactctaagatgaaacattttgagtgttgagaaaggtatatgaagctcggtagccggaggaagcacggtggatatacactggcgagaatcaggacggtcccacacgagacaagatttacctctcccaaaagcacaagtggaaggagcataggataaaaattagtacatgaaattaggtttcaagaaggatatttgagaatgtgctttgtgaggcatcgtcagtaggagtaagcaatccagtcaaatatattcttctttttttctctgcctttgcttttgtccactataaaacaaatctcatcctcctctcttgccctacactcacaaaacaaacacactctcttcttgatcattttctcttttgagtttttgagtttaaggacttaaaagagaaaacgctatg

SEQ ID NO: 4871 - DNA, 901 bp, rice ExpB5 longer Promoter
gttgatgggccgtagaggagtataatggcaacgtttgacgagacatctagaaattataaaaataaaacccaacgtgacaataaactctaaaaactataaaatctattttttaaaggttccaagaagtatgaatagaaatagtgatagatcgagcaagcaaataaagaagaagatgacataaggggtagtaattggtgtgacttttaaaaactatataattaaaaacacgagaatgatatggtttggtctttcaaagtcttaagataatgagatagctatttaacaaattttgaataaatcatattaaaatagataattttgtatgggtgctaattgcgcgggctacccagctagttcgattgaattgctgccactaagtgttactatacaacattctcctctaaaagaactatatatatttctccaaaagaaaaaggaactatatatgtaccatatgtacaaacattcgagtggccgggcatgatactcgctactttgctaggcacgttgcgcacgtacagctcacgctcaagtcgtacacattatggagtagccatttgacaaacgtacggatgacacaagacgaatatcaaattgcgaattttcaaagcgtttctaaccaacacaactaccttgtgagaatagtttatccaaacccttgcggctgcgtgatcacctccttcatgcaaggacctccgtaaagtccacaagtatactcttcgatcccacacacacatagttgacatacacatcaacacatgtacaaattcaagttgccacgttcacctcaataatgcttgggtacacataatttgctaccacgtttgtgaccgctaatcttccctataaataccaaccaaatcaaatcatcttaaaaatcaccgagcaatctccgcttaac

SEQ ID NO: 4872 - DNA, 844 bp, rice ExpB5 Promoter
taaaaataaaacccaacgtgacaataaactctaaaaactataaaatctattttttaaaggttccaagaagtatgaatagaaatagtgatagatcgagcaagcaaataaagaagaagatgacataaggggtagtaattggtgtgacttttaaaaactatataataaaaacacgagaatgatatggtttggtctttcaaagtcttaagataatgagatagctatttaacaaattttgaataaatcatattaaaatagataattttgtatgggtgctaattgcgcgggctacccagctagttcgattgaattgctgccactaagtgttactatacaacattctcctctaaaagaactatatatatttctccaaaagaaaaaggaactatatatgtaccatatgtacaaacattcgagtggccgggcatgatactcgctactttgctaggcacgttgcgcacgtacagctcacgctcaagtcgtacacattatggagtagccatttgacaaacgtacggatgacacaagacgaatatcaaattgcgaattttcaaagcgtttctaaccaacacaactaccttgtgagaatagtttatccaaacccttgcggctgcgtgatcacctccttcatgcaaggacctccgtaaagtccacaagtatactcttcgatcccacacacacatagttgacatacacatcaacacatgtacaaattcaagttgccacgttcacctcaataatgcttgggtacacataatttgctaccacgtttgtgaccgctaatcttccctataaataccaaccaaatcaaatcatcttaaaaatcaccgagcaatctccgcttaac

SEQ ID NO: 4873 - DNA, 602 bp, barley ExpB1 Promoter
cgtggagttgaaactggttcggggtttgcgtcgtcgcccaactcgcttgtccgtcggctccggccggtggtaaagacgaggagatggcaccgcaggaaaacaaggctgtcttcgatggccgacgacttgagacaccgttattttgatgaaggcaccatgaaggctttcggtgtcgctttaccttcgggggacatcgtttttggagtagctacaggctagagggatgggtcaggatggaccgtttatgaaacgtgcgaacattttatttgaagggtacgaaacattttgaaggctgcataggatggaccgttgaaccccacgtgcacgcaatcacgcaacaaacccggccggatgagtcctctttatccaaaatctccggagttgaaagagccttcagcgccatggctccgtcatcaaaggatcggccggctccgtctcagttgaccacagtgcaaagtatgtatgcgcaccctctccgtgaacaagttgccgccacgttcgcctccataattcgtgtgtgcacgactaaacgtattcgctcccacgtttataacacctagaccttccttatcctatatataccaaccaaccgaaccacccca

SEQ ID NO: 4874 - DNA, 1729 bp, Barley SS2 Promoter
gaattgtagtaagtcacgggtgtttatttgatccagactcttttgtaaactaaaggcctctacctacatataaaggagagccctcgagttagaaagatcaagtaaacaactctcgagagctaggttagtgattacgcatccttgtagttgagatccccatcaacatagacaccaaagcaggacgtaggcttttatctccattgaaggggccgaacctgggtaaatccacctctcgttcccgattaacctcttcgagtcgccacaccgccatgatggcctcaacactaagtccgttcacgagctaggtcatgtcgtttggtgacattggccctagactcggagcccgacatcatggggacgaggctccatcgctagggttgcgctccaccccgtgtagttagtcgccactctacctacaaccaatgctcaccacctccattccgtcgcgctcacgcaccttgagttgtcgacgccgctggaaccgagccccactcttgtggatgcaatggggccagagtgactccgacaacggagctcgagtttcctctcgggactagcaaagtgccagctggacgactaactcctcctcgtccgcacatgaggacgaggtcccacccgatggatccagagttgtcaaattcaggctcgctattggccatgtcagaaaagggtggagatcactagagaggagttgggggtggagcggagtggactcggagtgggtggttagggtttcgtttggatagggacacattatgaggccgaggtgggttggtcggggcaagattcaatgtgaagaatgtgtcggggcacctcatatgacatatatgaccggtttaagggtccgattagatggcattttcgtgactagaccgtccgctcagacataaatggacgtgttaagtgcaagacaagttacaaaccaacatgtatatcaaatttaagttctaaactacactcatgcttatatttttcttaaattatttcaaaccttccaacgatgcgacttcaccaggagatgtttctgtcatgaacatatatgcaaatgtattttgcgttaccgtgtttcaaaaagaaaaaagtattccatccgtttttaaatataaaaccttttagagattttactgtagactacgtactgcgatggaaattaaaatgcaaaccacatggcagcggcatacgagagccattcatcgctacaggacactttgcatcggtagccagctagtttccgacggtaccgacgagccgcagagaacttctaaatgcggtttttatgtgcagggacaaacgcgggtttctctgtctgcggaacagaaaaacaaattcggttcccagcaaaaacaaaacaaaacaaagaaacaaaaaaactgcggttgcacgtagtaacaaagtctgtcgcgcacggagcatctcatgcagccgatgatggctcgccagcacgaaaacacttgtcacggcgcgctcccacgaaccggaaacacttggcgcggtgcgtccctccgaaccgaagcacctgtctctaccgcctcgggaaccgggcgctaatctccaaatcaggccggaggcctccacggccgtcgatgcgatgccgccaagagccagtgcggaaaagagagtgtccttttcccccggccgcccggcgagaggaggtggcagcggcgcctgacgcacgcctcctgctggcagctcctccggcgcgccgcgtgtataaataggggcgcagcgc

SEQ ID NO: 4875 - DNA, 879 bp, rice PG5a Promoter
aagcttgcgcgcggaatacggtggtggagatgggttgggaaccctggattccaaacacagcccaagtctatccaaaatgtttagacaagaaaatacgtaacaagttggtttacagaaatagcaattagatcaatcctgcactacaagtagagtaaagtggtgatttctcttaaatctctcgaatggtgatttaagaattcagtgcaaaccaaatccttgctataatcaaatgttcggtaccccatcaacggaacaataaaaagcgcctggctaccataattttgtcattcttcttcaatttgtaatttaagatgcatgaggccacacgaccttaatgttcaacgtgtcatgcattagtgaaataatagctcacaaaacgcaacaaatatagctagataacggttgcaatccttaccaaactaacgtataaagtgagcgattagtcatatcattatctcccgcctgctaaccatcgtgtacaccatccgatccaaaaatgacaacttctagggatgaacctggacaaggtttagggtttagggatgaatctggacaatgattgttcaggttcatccctagatgttgctttctccttacgggacggagggagtatatgtgatggacacaaaagttactttcatgatgaaaggaaaggggatttgttggggcactaatagaacatctgtccaaatggcatgactcacttatatcctaataggacatccaagaaaaactaacactctaaagcaaccgatgaggaattgaaagaaaatacgtgccaccgcatctataaatggacaagcgcaatggaaaccctcctcatcgttcacacagttcaagcattatacagcaaaatagaaagatctatgtcccagagca

SEQ ID NO: 4876 - DNA, 666 bp, CaMV 35S (QFNC) Promoter
gcatgcctgcaggtcaattctcatgtttgacagcttatcatcggtgcgatgccccccatcgtaggtgaaggtggaaattaatgatccatcttgagaccacaggcccacaacagctaccagtttcctcaagggtccaccaaaaacgtaagcgcttacgtacatggtcgataagaaaaggcaatttgtagatgttaacatccaacgtcgctttcagggatcccccctcagaagaccagagggctattgagacttttcaacaaagggtaatatcgggaaacctcctcggattccattgcccagctatctgtcacttcatcgaaaggacagtagaaaaggaaggtggctcctacaaatgccatcattgcgataaaggaaaggctatcgttcaagatgcctctaccgacagtggtcccaaagatggacccccacccacgaggaacatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacaggcttcttgagatccttcaacaattaccaacaacaacaaacaacaaacaacattacaattactatttacaattaca

SEQ ID NO: 4877 - DNA, 781 bp, PJJ 35S from Brachypodium Promoter
tcgacctgcagccaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttagcttcatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactcttgaccatgg

SEQ ID NO: 4878 - DNA, 877 bp, CaMV 35S (OLD) Promoter
aagcttgcatgcctgcaggtccccagattagccttttcaatttcagaaagaatgctaacccacagatggttagagaggcttacgcagcaggtctcatcaagacgatctacccgagcaataatctccaggaaatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactctagaggatcc

SEQ ID NO: 4879 - DNA, 2322 bp, Arabidopsis At6669 (OLD) Promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctgattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcagacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctacctccttttgcattcttaactttatcttctctacttatttcttttttgggatttttgggggtattattttatcttttgtagatatacacattgatttactacaaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaaaactaaaaaagagaaccccaaaggatcc

SEQ ID NO: 4880 - DNA, 2318 bp, Arabidopsis At6669 (NEW) Promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctaattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcggacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctactcccttttgcattcttaactttatcttctctacttatttcttttttgggatttttgggggtattattttatcttttgtagatatacacattgatttactataaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaagactaaaaaagagaaccccaaaga

SEQ ID NO: 4881 - DNA, 1321 bp, RBCS Promoter
ccaagagtcgttgtctccatgacaacgcccccaaggaggaaatcgacgtaaaaacgccgttgtcgcccgatctggccatagccaaatcttaggttttcacccgaagacaccaaacatcaaagtgagggaaagtgaagctcttcgacgacacctccaagaaggaaaacggcgctacaacatcgttgtcttcggcatacctcgcacacgggcagttttcatccagagcaacactccaaacaccggagccgacgtccatacctcgcacacgggcagcagccgaagacgcgaccgaaaatgaaaaccacgccaccatggcatcgaaaaggaccgacttggaccatgtatggccgcagcagcagcccatctgccgccggtgaagttcaatcagccgcctcaccaaactgagaggaaaaatgatggaaacgaagagacctgggacatgccggatcagccggaggagatgacggatctggccaacgagtagctagatccggccgaagagcgccgccgtgaagccgcgcagccacgagcagaccgagcaccagggagaggaagaacgaggggaaacaccggatccgggaggaagccggccggatctagccgaagacgaggcatagcctgccggatcgggccggagacgccgcgaccacgatgaggcagcacctcaaacgcctcagccaagagctctaggacacccccgccaagaaaaacagccccgccgccgccgtccccgtgcgggctttgcccggcggcggcgagggggaggagaggacggggagaggctgctgccggggctggtgtggttgccgcccgtgtcgccccagactgagcgacgcgggggcaagcttcgttctcgataagatcttagaagagtttctcttaatttgttgttcctctagttcataaaaagtgctgctcattttgcattaactcattacaaattttctaataagtgggcgagattttttatggattggagggattagcaagttctgtttttgagtgcatgccgtggcacattggatctatcctgataggtgaaaattggtcacttcatggcatgatttgcagagtgcgttgcagccaattgtatccgtccagaggataacgcgcgccatttcgtgcggccatgtggcgcccgacctgatccgtaggatgccagcgtggcctgggcaaatccgcgcggcgaactgcagccacccctcctagatcttgtgctgatattggatgggtggggagcctacagttatataagccgctgtagctagagagcactcaagcaagcctgcctcctcttgttagctatctacgtacgtgtacg

SEQ ID NO: 4882 - DNA, 1599 bp, Arabidopsis AT5G06690 Promoter
ggaccatttgtttagacgacattgttaaggggatgacttaaagtgatgagtttcaaattaaaatacccctcgtttttggagttatttacttaaaatgccacttcaaagaagcgtgtcggtgtgttcgagattcgaattttaattactgtcttttgcccctatctatatatatctcactttaatcacacttttattatcgttaatgtttaatgtttatttatgttaatgaaggattagtggttagtggttgtgttactaattgttcgttgctaatgtccttgaaaggtgtaatttgtatgatctatctaactaaattatccggaaataatgcggttgaaataaaatcacgatacatattaggatatcacaatctatttatagtatattttagtcgagatttgaaaataaaaagggaatatattactcgattaaagacattttcaaacgcaaaatcgtatataactatagattgaatcatatatatatctgtgactcaagtcttttatctttgttttttggtttaatgttaaaactttatatcaacaaagacttttatcttgtatcttatgtttactatttctgatgagtaaatattaattttgtaggtaagtaaggtggcaggtttgggtaaagaggaaatcaaaaatgtatggtaggatagtacttgacaaaatacaaaattctaattcgcgtttattaaagtccttagcgtgtggactctacttgtttaatttcgactctctaaacgtcggcctttattttctttcaaacgtacttcaccaactctattagagagatcgattataaccgacaagcataagtatgtgatttctatattagtttatatatagctatgtcttcgaatgattatttatagtaaacacataattatacgtaataagtccgagagtatataaactatgaaggataattaattgaagacaagaaaattaacgaaatagtgtggggaattcccaaggcatcatattcagatcaatgcaccgtcacaagtttggctattctttatttggttttctgattaacacaaagttttaaatagttttgaacgtttctaatccatttgaggcagtgattttttctgttccaagtattttatgttcaatattattaggaatgtgaacggaacgatttttttttttttttgtggaaccgagcgaccaaatttgagaaaataaaacaaattagattgatttaacatttagacgaggtttaattagaaaggaaaaaaaaaacacaattttatataaatatgaacagccaaaataattttcctagagtttataagttcagggtttacctttttcatagagaaaactaataaagtcactattaacattttaagaatatacatttttaaaacaaattataaagacaatgagagaaaggtagcccccaccagtagcacatcgttggcattgtccaactcatcttccggataagctctctatccatctcctcacatctcttcccaaaactttcaaaaacaaaaaaaatatcttaattatggcatttgaaaacttaaaaatatctcgtcacatatcttcatcgacaaaaaatttactgaaagcgaaaaaaata

SEQ ID NO: 4883 - DNA, 1774 bp, Arabidopsis AT5G61520 (AtSTP3) Promoter
ctgttatgaggtgttcttgcacggcatgtctagttgcaggctgctgaagaattgcccaccggcttttaaacaacgacccaactctttctgcaacatctgcaacattcactttcgcatccttagcaacttccccgacaaaactaccagcagtctgccctgcttccctaagcttcgttcctaattcagtaactccatagtaagctttccaccataaacactcacagagagaaacgaaatgaggttagcatagaaattatcaaacctgatgaagaaaagaatccactagtcctctcctgccattgctgtgagatgagagaaggcattatccaataccaaccactttaaacaagtcactagaaacctgtttgcatcaagaaacaaatgggaagatatatacttattcttagcaaattatgatacaacctcacaagcggtattatccgttgtaatcaacttcatcacatgaaatcatcttcaatctaatcatatacaattgatacagaagaaacacaaaagaaaaccaaaaccttgacttcatcgtcaaccatggaatgaatttcttgacaaagaataaaaaccaagtctttaactgccaaaaggagataacttttaaggaacacaaaccctaatcctatattctctaatcaatcatatacgagaatcaaaaagaacaaatagaacaaaagcaatccgatcatcaaacctttagaacaatccccagaaaaattgagatagctgatgatcgaatcgaactaaacccaattcctcgatacgatcaaagacgacgaagacgagagtcagcgatatgatgaaaaagaaattgatcgctccaggagatgaaaaggttccacttttttaatttccccctggagcagagaaaaaaagatattattgctgtttaggtaaaaaaaaagtcggctttgaattttgaataggaaagtcttcttccctttgcaaatcacagatattctctccgtcacggactgtgacggtaataaatattctgttggtgccacgtgtaataagtttttctcttcacaaaaatggtccttcatcttcttttagtatctcatttgtgacctaagcttctaatttcacagcttatcatccccttaatgttttaagttttttgaccatagagtaaaattattttactataaaattaaaagcaaaaaataaaatttactataaaattataattataaaaagtgaatgtaaaaatgattccataaatttacatgattgatagtaattattctgccaacttaattccacatgtatatcagtatttatatatagaaaatgatggtttttctacatagtcaaattccaaaacaaaatatcagtattatggaattaaacaatcaaagtttgcaacttggtatgtccaatatcatcgaaagagctttatcattcagtcgttgaaaaaagtatagccatctttttcttctatcgattttcaaaaaaaaaaaaaaaaaaaaaaaaaaaaaaaaaaaaaaaaaaagaggaagataatgaaggtaggcagtgaaaagtctttcttcacatgtcttttattgtccactttcgatatctcatcagccagaaccgaaacaaacaaaaactataagtcccacactcaagtcaattaaagcactccaatggtccaacaagtttcgtcgtctaccttgaaactcaacctttggatgattgatatacaaaaatacaggatctaaaaacacctaccgaacttgaatagtaggtgtgttgtgtttgagtgtctctctaggtaaac

SEQ ID NO: 4884 - DNA, 1127 bp, Brassica napus NAPIN Promoter
attgattcctttaaagacttatgtttcttatcttgcttctgaggcaagtattcagttaccagttaccacttatattctggactttctgactgcatcctcatttttccaacattttaaatttcactattggctgaatgcttcttctttgaggaagaaacaattcagatggcagaaatgtatcaaccaatgcatatatacaaatgtacctcttgttctcaaaacatctatcggatggttccatttgctttgtcatccaattagtgactactttatattattcactcctctttattactattttcatgcgaggttgccatgtacattatatttgtaaggattgacgctattgagcgtttttcttcaattttctttattttagacatgggtatgaaatgtgtgttagagttgggttgaatgagatatacgttcaagtgaagtggcataccgttgtcgagtaaggatgacctacccattcttgagacaaatgttacattttagtatcagagtaaaatgtgtacctataactcaaattcgattgacatgtatccattcaacataaaattaaaccagcctgcacctgcatccacatttcaagtattttcaaaccgttcggctcctatccaccgggtgtaacaagacggattccgaatttggaagattttgactcaaattcccaatttatattgaccgtgactaaatcaactttaacttctataattctgattaagctcccaatttatattcccaacggcactacctccaaaatttatagactctcatccccttttaaaccaacttagtaaacgctcttttttttaattttatgaagttaagtttttaccttgtttttaaaaagaatcgttcataagatgccatgccagaacattagctacacgttacacatagcatgcagccgcggagaattgtttttcttcgccacttgtcactcccttcaaacacctaagagcttctctctcacagcacacacatacaatcacatgcgtgcatgcattattacacgtgatcgccatgcaaatctcctttatagtctataaattaactcatccgcttcactctttactcaaaccaaaactcatcaatacaaacaagattaaaaacatacaccc

SEQ ID NO: 4885 - DNA, 916 bp, Arabidopsis AT1G61720 (BAN) Promoter
ttgtacttttgaaattacagagatagagatttagttgttatgagtttatcgtcttgagacttctatataagaagtaaaaagatttgcaaatagtccttgctcattaggtacaacagtagatcaataaggctgttttagaaggtaagcacgtgatctttgaaataaccaacttgtcttcacctaagaatcaaaaaagattgaccttcagagttctgatttgttatcatctaccaaattatcacaagagtttgattatttctgtctctaaacaatataacacagctttagagtaacgaatagtgttacagtaaggttctgttacttcaattttttctttgccgatcttaaaatgagttgcaaaagaatgctttttacttccaccaatctgtcaaattctctgcagtttttaacacaacttggacttgctatgttctgtttcacgaattacacgagtcaattcaacataacttgctctgttcttgtccatgtttcacagaatctggccttaagcaattttatcatatttaagctacaaatccataacagagtttaacaaagataaaataaccagaaagttacattgaaagataaaaagtgaagaagacaaaaaaaagagagggtaaatcctaaatcgaaaacaaaagaaggcattggcaatagcattccgattttaaaaaaccgataaatctatgtatctaatggcttgttcttagaagcttcaacgaacatagaagcaacctcattcaaaaacttagtcttctccaacacaaattccaactccttagcttgcaacaacttatacttctcttcaacaatcttcttactctcaaccgaaaccaaactccattgctgcttcacataatactcatcaacacccaaactagcaatcatcctaacaagagacgagttatcaaac

SEQ ID NO: 4886 - DNA, 3965 bp, Arabidopsis ABI3 (AT3G24650) longer Promoter
catgttaagttttactagatacgttctcatctaactagatacgacctaaaatacgatatttgtggttttagttgttagatgttgtgtcacacgagagaaagaggtcgacgaagaaaaaaacaaaaagaagaagtaaaacgtagttattggcggacaagggataaagattgctttgaagtcagaaatgctgacacgtggcagcatatgaagacaacccgccgcttaaaaccacgaatggtgacgaaaggcttctttgtttgcatgtgcaaccaatctctctctttctctctgtctttactaattttggttgttcgtagaaaatgaaatatttgaacgaagaagataaaggttggtgatgtacgtatgactctaaattagagtttgataatttgtatgtaagattagatcggttttgttatttgcttgatccaatttattgaagtacatgtgaataatcgtgatatatgtcaatatatatgtgctataattaaatctattaacaaatttctttttatcgatttagttacaccatctttaatatatttctattttctattttaaactaaagcatagtttctccaatatattaatttatatatttactctaggatagaattagattcaaaaactagaatagagaatatagatgctctaaatagacaataattctattacttactctattttagagtaaaacatatagtgatgctgacaaaaatattattttataatagagtttagaaagaaaagaaaaaacaaaaaaaacttgaagatgctggaactattaaaaattaaagaaaaagtttaaaatgaataatgctttttattcttagttttttttttcttttttttcttttagttgatgttaaagttttagtcaaatctccaaaatttgcaaaaaagatacattagttacggacggatatatattaaataaattaagtcacaaatatcatatatatatatatatatattaattttttgcctagttttgttccaaataaaattttcaatttttagtgtacaatatttttcatcgtccaaatacacaaacacaacaaataataataccactaatttatttgttttctaatataattgaaccttttctaattttattaaataggctgaaaaccataaattatttggagccaagattaaattatgttacataaatccttttctcgtcatcaatactcaaatttaaatttttttattttcatagatatttttgggaatttaaaatccttccaaataaatttgggaaaataatagatgttttaaaatatttttgttattttcgagtagtttacactgattttacatcactttatggatcaagaccataaaatttaactacatttattataacttatttgaaaagacatgaaactttcattagagtttaggaaaatacggcaaactattagattatcaccctcttgtgactaatgttaatactatttggtaaagcaaataatcccataactaattttattttgatttgttcactatcaattgtatcatagacgatccgatgattaatgtacctaaattttgatttaaattgtattccttgtagtacgcatagtaaaacaaagttcacatgttcttttacaattggttttctaacattttagatttcattttaaactaaagaaaaagggtttttcgatcccaacaatttttaaagtatgtttttgaatttcaacaaacgactagtactgatatatacatcaatgcttacaaaaatcaaattatctatctcaacgtttacttttgtacgtaattacaagtcaatattaacaaatattagtcaactgtaacggttgttgactcaattgatacgtgtacgtttaggtggcatgttttttaataaaataattttgttttatgttttgggattaaaaatatttacttttaaaaaactaaaccgaaaaactggaacccccaacctcacatattcatcaccatcgtatccacaaacattatcgagacataaataataatttatagatatatagcaacaaattggaattaaattaatcaaacaatgtcatttagaattggggaaatcctaaccgacgttatatgattaattttaattccaatttatgtatgtgtatatatctataaattattatttatatattgatgatgttcgtgcatgatggtaatggtaacctttaaaacttttgaatctcaaaacgtaaaacaacgtcatttggtttgaagaacatgccatctcgacgtacaagtgttagctgattcaacaaccgttactgttaattaccataactaacgttgactcataattatgtacaaaagtaagagttgaggtagataatttgaattttttaaatgttaaagtatgaacattactaattgtttgttcagatttataaaacacagtacctattttgatgtgttaaaatgtaatcgggaaaataggaattttcccaagaaaaaaaaatacactaaaattttgatgtgttaaaatgtaataaatacaagtacctatttctttctacaacaggtatcacatgatctgctcaatctcattttgaaggcaaggtcgaaccctgtttgtaactaaatattttacaaatacactaaaagttttgttttgttttcctcatgcagaaaaaagaaaagaaagaagaagaaaaaaaactcacaaaaacatacattgttctacaatatgttaaagtaattgttctagggtaataaaatccgtgtctgcctcttccacttcaataggaaagtgtaagtttttcgaatctttttggccagataatttaaaaccgaccgaggaaacttacttttgtaaaagtgaccatttgcacataggaagtagaaagttgataattggaaaatttataatattttatacaaaagaagtgtttaagaaccaccgcttggtctcaccactcaaattcgaacgtatggctcgtgggcacaaactcctgtaccaacctttagatactagcggcacgaggagacttctattttctctttgtttttaagtttttttatcgacttaaatatggctttttgcaccatttaatttcaaaaccaatgtctttctctcgaggaactttgtttttatttcttagaagatgaggggagatttactatctaaataaaattttaaatgtttgtaagtattatgagctcaacaattttgtcaatagtgccacaaatttaaacgtttgctttttgtcttctttgaaaaatcaaatgctgaaaaactgttacatctctttttcttaaaaactcttgtctctctccttttccttctgctgaggtaattgaatgctgcaaagagaaagagaataacttaaacccaaaattacacttaccgccagaaaaaaaaaagagttcagtttaatctaacatattttatacaatacaattgaattatattagtaaaaaaaaaacttccatataaatcatggaacaaactggaacacatgggctctcttattttaatttattttcttttttgagggatttaaccatgtttattatatagttttataaatatatatataccatctctccataatttataaaatgaaagaaagagagagtcttcttgttggagtaaacccaaacggttttagattacttattagctgttcatcagttcttcctctctaaaagagtaaaacctaaacatctctctctgttctattagaaccaaagaccaatctttgtgaacaaaacacatctcgtatacttcagatctagactcgaaaattttagacctctttacaattggtctttgttcatctgaagttggagaaaatagttagcttaggtcggatcttttcatatgctttggatcctccttcgtctcttttgtataattttaaccttatcaagagttctttttgaatctcaaaagattatatagtagtatagaaggtttatatgtatatgtatagccagatagtttatgt

SEQ ID NO: 4887 - DNA, 4074 bp, Arabidopsis ABI3 (AT3G24650) Promoter
catgttaagttttactagatacgttctcatctaactagatacgacctaaaatacgatatttgtggttttagttgttagatgttgtgtcacacgagagaaagaggtcgacgaagaaaaaaacaaaaagaagaagtaaaacgtagttattggcggacaagggataaagattgctttgaagtcagaaatgctgacacgtggcagcatatgaagacaacccgccgcttaaaaccacgaatggtgacgaaaggcttctttgtttgcatgtgcaaccaatctctctctttctctctgtctttactaattttggttgttcgtagaaaatgaaatatttgaacgaagaagataaaggttggtgatgtacgtatgactctaaattagagtttgataatttgtatgtaagattagatcggttttgttatttgcttgatccaatttattgaagtacatgtgaataatcgtgatatatgtcaatatatatgtgctataattaaatctattaacaaatttctttttatcgatttagttacaccatctttaatatatttctattttctattttaaactaaagcatagtttctccaatatattaatttatatatttactctaggatagaattagattcaaaaactagaatagagaatatagatgctctaaatagacaataattctattacttactctattttagagtaaaacatatagtgatgctgacaaaaatattattttataatagagtttagaaagaaaagaaaaaacaaaaaaaacttgaagatgctggaactattaaaaattaaagaaaaagtttaaaatgaataatgctttttattcttagttttttttttcttttttttcttttagttgatgttaaagttttagtcaaatctccaaaatttgcaaaaaagatacattagttacggacggatatatattaaataaattaagtcacaaatatcatatatatatatatatatattaattttttgcctagttttgttccaaataaaattttcaatttttagtgtacaatatttttcatcgtccaaatacacaaacacaacaaataataataccactaatttatttgttttctaatataattgaaccttttctaattttattaaataggctgaaaaccataaattatttggagccaagattaaattatgttacataaatccttttctcgtcatcaatactcaaatttaaatttttttattttcatagatatttttgggaatttaaaatccttccaaataaatttgggaaaataatagatgttttaaaatatttttgttattttcgagtagtttacactgattttacatcactttatggatcaagaccataaaatttaactacatttattataacttatttgaaaagacatgaaactttcattagagtttaggaaaatacggcaaactattagattatcaccctcttgtgactaatgttaatactatttggtaaagcaaataatcccataactaattttattttgatttgttcactatcaattgtatcatagacgatccgatgattaatgtacctaaattttgatttaaattgtattccttgtagtacgcatagtaaaacaaagttcacatgttcttttacaattggttttctaacattttagatttcattttaaactaaagaaaaagggtttttcgatcccaacaatttttaaagtatgtttttgaatttcaacaaacgactagtactgatatatacatcaatgcttacaaaaatcaaattatctatctcaacgtttacttttgtacgtaattacaagtcaatattaacaaatattagtcaactgtaacggttgttgactcaattgatacgtgtacgtttaggtggcatgttttttaataaaataattttgttttatgttttgggattaaaaatatttacttttaaaaaactaaaccgaaaaactggaacccccaacctcacatattcatcaccatcgtatccacaaacattatcgagacataaataataatttatagatatatagcaacaaattggaattaaattaatcaaacaatgtcatttagaattggggaaatcctaaccgacgttatatgattaattttaattccaatttatgtatgtgtatatatctataaattattatttatatattgatgatgttcgtgcatgatggtaatggtaacctttaaaacttttgaatctcaaaacgtaaaacaacgtcatttggtttgaagaacatgccatctcgacgtacaagtgttagctgattcaacaaccgttactgttaattaccataactaacgttgactcataattatgtacaaaagtaagagttgaggtagataatttgaattttttaaatgttaaagtatgaacattactaattgtttgttcagatttataaaacacagtacctattttgatgtgttaaaatgtaatcgggaaaataggaattttcccaagaaaaaaaaatacactaaaattttgatgtgttaaaatgtaataaatacaagtacctatttctttctacaacaggtatcacatgatctgctcaatctcattttgaaggcaaggtcgaaccctgtttgtaactaaatattttacaaatacactaaaagttttgttttgttttcctcatgcagaaaaaagaaaagaaagaagaagaaaaaaaactcacaaaaacatacattgttctacaatatgttaaagtaattgttctagggtaataaaatccgtgtctgcctcttccacttcaataggaaagtgtaagtttttcgaatctttttggccagataatttaaaaccgaccgaggaaacttacttttgtaaaagtgaccatttgcacataggaagtagaaagttgataattggaaaatttataatattttatacaaaagaagtgtttaagaaccaccgcttggtctcaccactcaaattcgaacgtatggctcgtgggcacaaactcctgtaccaacctttagatactagcggcacgaggagacttctattttctctttgtttttaagtttttttatcgacttaaatatggctttttgcaccatttaatttcaaaaccaatgtctttctctcgaggaactttgtttttatttcttagaagatgaggggagatttactatctaaataaaattttaaatgtttgtaagtattatgagctcaacaattttgtcaatagtgccacaaatttaaacgtttgctttttgtcttctttgaaaaatcaaatgctgaaaaactgttacatctctttttcttaaaaactcttgtctctctccttttccttctgctgaggtaattgaatgctgcaaagagaaagagaataacttaaacccaaaattacacttaccgccagaaaaaaaaaagagttcagtttaatctaacatattttatacaatacaattgaattatattagtaaaaaaaaaacttccatataaatcatggaacaaactggaacacatgggctctcttattttaatttattttcttttttgagggatttaaccatgtttattatatagttttataaatatatatataccatctctccataatttataaaatgaaagaaagagagagtcttcttgttggagtaaacccaaacggttttagattacttattagctgttcatcagttcttcctctctaaaagagtaaaacctaaacatctctctctgttctattagaaccaaagaccaatctttgtgaacaaaacacatctcgtatacttcagatctagactcgaaaattttagacctctttacaattggtctttgttcatctgaagttggagaaaatagttagcttaggtcggatcttttcatatgctttggatcctccttcgtctcttttgtataattttaaccttatcaagagttctttttgaatctcaaaagattatatagtagtatagaaggtttatatgtatatgtatagccagatagtttatgttgtttaaagattcgatgatagccaagttgggttaactttctttttccttgcctccttactcacatacaaaccctatctgtccgtacaaaatactaaaaaccctaacttt

SEQ ID NO: 4888 - DNA, 1700 bp, Arabidopsis (AT1G69120) APETALA 1
ttagactgatttctctatacactatcttttaacttatgtatcgtttcaaaactcaggacgtacatgtttaaatttggttatataaccacgaccatttcaagtatatatgtcataccataccagatttaatataacttctatgaagaaaatacataaagttggattaaaatgcaagtgacatctttttagcataggttcatttggcatagaagaaatatataactaaaaatgaactttaacttaaatagattttactatattacaattttttctttttacatggtctaatttatttttctaaaattagtataattgttgttttgatgaaacaataataccgtaagcaatagttgctaaaagatgtccaaatatttataaattacaaagtaaatcaaataaggaagaagacacgtggaaaacaccaaataagagaagaaatggaaaaaacagaaagaaattttttaacaagaaaaatcaattagtcctcaaacctgagatatttaaagtaatcaactaaaacaggaacacttgactaacaaagaaatttgaaacgtggtccaactttcacttaattatattgttttctctaaggcttatgcaatatatgccttaagcaaatgccgaatctgttttttttttttttgttattggatattgactgaaaataaggggttttttcacacttgaagatctcaaaagagaaaactattacaacggaaattcattgtaaaagaagtgattaagcaaattgagcaaaggtttttatgtggtttatttcattatatgattgacatcaaattgtatatatatggttgttttatttaacaatatatatggatataacgtacaaactaaatatgtttgattgacgaaaaaaaatatatgtatgtttgattaacaacatagcacatattcaactgatttttgtcctgatcatctacaacttaataagaacacacaacattgaacaaatctttgacaaaatactatttttgggtttgaaattttgaatacttacaattattcttctcgatcttcctctctttccttaaatcctgcgtacaaatccgtcgacgcaatacattacacagttgtcaattggttctcagctctaccaaaaacatctattgccaaaagaaaggtctatttgtacttcactgttacagctgagaacattaaatataataagcaaatttgataaaacaaagggttctcaccttattccaaaagaatagtgtaaaatagggtaatagagaaatgttaataaaaggaaattaaaaatagatattttggttggttcagattttgtttcgtagatctacagggaaatctccgccgtcaatgcaaagcgaaggtgacacttggggaaggaccagtggtccgtacaatgttacttacccatttctcttcacgagacgtcgataatcaaattgtttattttcatatttttaagtccgcagttttattaaaaaatcatggacccgacattagtacgagatataccaatgagaagtcgacacgcaaatcctaaagaaaccactgtggtttttgcaaacaagagaaaccagctttagcttttccctaaaaccactcttacccaaatctctccataaataaagatcccgagactcaaacacaagtctttttataaaggaaagaaagaaaaactttcctaattggttcataccaaagtctgagct

SEQ ID NO: 4889 - DNA, 1096 bp, RootP Promoter
tcagatgaagaaggcggcttttgcacgatttcataatggctacgtatttggcagataaagttattgtgtatgaaggagaaccttccgtggattgcacggcatcttctcctcagtctctacgtagtggaatgaatttgttcttgtctcgtttgaacatcactttcagacgagatcctacgaatttcagaccaagaatcaataaactcgattcgatgaaggatagtgaccagaagcttgcgggatgttattactacttggatgattaagagagagatgacattgagagaatctttcaccggagaaaacctgaagtagtgagaaactcacgttttgatctttcctagccccttcaatctattataagatctcttgaattttattagatccatctggagtttaatttttgagaatatattatggtgtttgaattcggtttgtttcaatcgttcccatatattagactagtttttttcttcacacatgagaatctcaaaccgattgcgtagaagaagaactcgcattcatctgtttttgtctttagttgagaatgaatgaccgttgtaatgtcatgggcttcttttggtttgggtctgaatcacttaagcccaacacaatctcttcttaggttgaaacactgttgtttttgctgttttgtctgacacaaggcatcggatgatgtcgattgtcgaatatgcttcctcattcggagtgttctcagacatcttgagcttctcattagttaggcggtgcgctcgaaagtcgaagccgtgttgacatatcaaaacattgggaccattcaattttgtacaaatgtccaaacattatttcggtttgataacaataaacaaataaagaaagagttttttattggattcacttggcaacagccaacaacgaatcaaataatctatatacataattatattagaagctgtgaatgtgcctccgagtagacaaaagcacatgcaccataaatgatcaaacccatgaaacttccatctctctttttcccctatataaactaatgtcacttacctcaatattccatcaacaatatacatctgagatatcaaaactcctagagagatctaataaa

SEQ ID NO: 4890 - DNA, 2432 bp, arabidopsis ATTPS-CIN (AT3G25820) Promoter
atgtcaattttcatggcacatcgaggagaaactgtttccttgtggtaatcctttataatctctgttgctaggaggagatttttcattaatagtctatctttcacaaaggcagattgatttgaagagatgaacttgggaagaatgattttgagtctgtttgcaagaatcttcgatatcaccttatagagaacattacagcatgatatcggtctatagtccttcatcatcacagcttcttttctcttgggtatcaaggccaaaatagtggagtttactcctttgggtaggaagcctgtcttaaaaaaagattggatggctaccacaaaatcgtttcctactatcgaccatgtctcgttaaagaactcacaagtatatccgtcagggcctggggatttatttgaaggcattgagaagagaactttccgcacctcctctgcagtgacttctagtgtgagcttgtcttgtcattctcatcacatctataatccagtagagtttccagttcctcccgcgaccaatccacgtagtctggcggtttgagcgttaaaaagtctctgaagtatcgaactgcctctgcttttatttgctgctgatttgatgcaatatgtccatcatcacacttaatctctctaacattgttacgaacctcccgaatctttgcagcattgtagaaagttttattattttggtctcctatcttcatccaatgcagttttgctttttgcctaaggtagctttcctcaatacccgacagccttaaccacttctcatatgcgtccgcttcagctaccactgcctgtgaagatggccttgtcatagtttctgcttgcttttcacataaagttttataggcttcttttgctttttttgagatatcaccaagtaactgcttccccatctttctgaaatgtggcttcagaccttttaatttttttgataagcggtgcatggctgaggtagaatgaaagagaggctgagttgtcttccaaagctcttctgtctcacttctgaaatccgaatacgaaattaaagcatttataaatttaaaaggcctcttgactcgttgttcctgctccataatatagaatcgacatcttaggtgatctgaacaaccgcctgattcaaagacgctgtaggactgttcatactattgcatccattgcttgctaatcagtaccctatccagcttcttacatattactccttcctttctcttgttacaccatgtgtatctctggccttggtagctcatatctgttaattcacaatgtctgattaagtcttgaaaatctctcatcccttggagaacgaatggagatgattcatagagtgaatggtcctctccttctaatatctcattaaagtctccacatattaaccaagctttgttatagaacaaaggggaatcatgatgatatttaatatcactccacaaatcctttctttctgctgcaaaatttgatgcataaacaaacgacacaaagaactcttcttgtcttccttctaataagacagagcaagtgatgagttgtgacgtcttatatattggagatacacgcacgttatcttctattatctttcaatagtaatttgatataaattaagataatgtgcagtgaacgagtggcgattgttaagccaagtgaacattatatactttattttatactttctccaagcttcgaatggagaatttatttccatacgactaactctacctaaaagggccatgtttgtttgccaacataacacgacgatcacgagatacacataacatttagaatttggagaagatacattttgtttgacttcactttttgtgcgaatggctgttctacctgaaggggccattagtataatttttttgtacataataacgtcaccaaatataacacgagaatcacgaggtacacaaatcatttaggcttggacattatctaatcaaataagctatgatatcaaatttacatacatatagtggcctcgtgggtataattacacaaggagcttttggagaaaaagaagtgtgtgatttaaatgacaattatacaaatgtgtacaattatcagatccaaagttcatgttttaaatcatcaaaaaaataataattgatgagttaaatgatatttttttcatttagatttagttagattagttgtacggttgtaccattatttaataatttaaaagttgaaatgattataatgtataaaagttgaaaatattgtaacagatatagattaagcatttttgcggtcaatatattataaaagcttttttagctattaattgaaaaatattttacacccttagatcttttgatctcctaattatataaaatattttcttctaccgtttgtctatataaccatatgtgttgtctagtgcatgtattcagccacgaataagagaatagtctactaaatcaatgg

SEQ ID NO: 4891 - DNA, 277 bp, NOS TERMINATOR
gagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattc

SEQ ID NO: 4892 - DNA, 538 bp, 35S pEBbVNi Promoter
catggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggact

SEQ ID NO: 4893 - DNA, 31 bp, Artificial Sequence
  Primer
aaaaggcctaaagagaatcagttgggcagtg

SEQ ID NO: 4894 - DNA, 34 bp, Artificial Sequence
  Primer
aaaaggcctaagaacagcactgtataacccacac

SEQ ID NO: 4895 - DNA, 31 bp, Artificial Sequence
  Primer
aaaaggcctaagacaagaccgcagagtatgg

SEQ ID NO: 4896 - DNA, 31 bp, Artificial Sequence
  Primer
aaaaggcctaaggatcagagcaggagctagg

SEQ ID NO: 4897 - DNA, 31 bp, Artificial Sequence
  Primer
aaaaggcctacattgatgactgcgaatatgg

SEQ ID NO: 4898 - DNA, 33 bp, Artificial Sequence
  Primer
aaaaggcctagcgtaacaagaataacgtcagca

SEQ ID NO: 4899 - DNA, 31 bp, Artificial Sequence
  Primer
aaaaggcctaggactacatcaagcaaggtgc

SEQ ID NO: 4900 - DNA, 31 bp, Artificial Sequence
  Primer
aaaaggcctatggatctttcctacttgcgtg

SEQ ID NO: 4901 - DNA, 32 bp, Artificial Sequence
  Primer
aaaaggcctcagactcttctactgctccatcc

SEQ ID NO: 4902 - DNA, 31 bp, Artificial Sequence
  Primer
aaaaggcctcatggccaaacaggagaagtag

SEQ ID NO: 4903 - DNA, 34 bp, Artificial Sequence
  Primer
aaaaggcctcccacactctagtagttgaccaaag

SEQ ID NO: 4904 - DNA, 31 bp, Artificial Sequence
  Primer
aaaaggcctccgataggatcctcaaattacg

SEQ ID NO: 4905 - DNA, 31 bp, Artificial Sequence
  Primer
aaaaggcctctaggaacgaagtggtgagctg

SEQ ID NO: 4906 - DNA, 34 bp, Artificial Sequence
  Primer
aaaaggcctctataagttccaagccatcatggag

SEQ ID NO: 4907 - DNA, 31 bp, Artificial Sequence
  Primer
aaaaggcctggtctcctctcgcactttgtag

SEQ ID NO: 4908 - DNA, 31 bp, Artificial Sequence
  Primer
aaaaggcctgtaatgcctcttggtcttggag

SEQ ID NO: 4909 - DNA, 28 bp, Artificial Sequence
  Primer
aaaaggcctgtcagatggtgcaaattgc

SEQ ID NO: 4910 - DNA, 31 bp, Artificial Sequence
  Primer
aaaaggcctgtggtgagctgctccaattatc

SEQ ID NO: 4911 - DNA, 31 bp, Artificial Sequence
  Primer
aaaaggccttgtatcgaaatttcctgcttcc

SEQ ID NO: 4912 - DNA, 36 bp, Artificial Sequence
  Primer
aaaaggcctttacctcagtggtggtctgttctactc

SEQ ID NO: 4913 - DNA, 31 bp, Artificial Sequence
  Primer
aaaaggcctttgtcatgtaccatgtgctgtg

SEQ ID NO: 4914 - DNA, 31 bp, Artificial Sequence
  Primer
aaacccgggaaccaaccaaccctagatccac

SEQ ID NO: 4915 - DNA, 27 bp, Artificial Sequence
  Primer
aaacccgggagccatggtttagcggag

SEQ ID NO: 4916 - DNA, 29 bp, Artificial Sequence
  Primer
aaacccgggcattgctcaccttttccgtc

SEQ ID NO: 4917 - DNA, 31 bp, Artificial Sequence
  Primer
aaacccgggcgattctcatagcagctgtttc

SEQ ID NO: 4918 - DNA, 28 bp, Artificial Sequence
  Primer
aaacccgggctcaccttttccgtccagc

SEQ ID NO: 4919 - DNA, 30 bp, Artificial Sequence
  Primer
aaacccgggtagaatcgcaaggagaggtgg

SEQ ID NO: 4920 - DNA, 31 bp, Artificial Sequence
  Primer
aaacccgggtagatccaccacaggagaggag

SEQ ID NO: 4921 - DNA, 36 bp, Artificial Sequence
  Primer
aaacccgggttaatgctgagcagtgatcagttagag

SEQ ID NO: 4922 - DNA, 26 bp, Artificial Sequence
  Primer
aaactcgagaaaagcctcatcggcgt

SEQ ID NO: 4923 - DNA, 31 bp, Artificial Sequence
  Primer
aaactcgagacattggtggcgcttactctac

SEQ ID NO: 4924 - DNA, 30 bp, Artificial Sequence
  Primer
aaactcgagacgaagcagcaacaaagatca

SEQ ID NO: 4925 - DNA, 36 bp, Artificial Sequence
  Primer
aaactcgagactactttactagacggtgaatttgtg

SEQ ID NO: 4926 - DNA, 31 bp, Artificial Sequence
  Primer
aaactcgagatttaggatggctagcatcagc

SEQ ID NO: 4927 - DNA, 31 bp, Artificial Sequence
  Primer
aaactcgagcaccattgctgagcttcttctc

SEQ ID NO: 4928 - DNA, 33 bp, Artificial Sequence
  Primer
aaactcgagcactagcagtagcagtgagcaaag

SEQ ID NO: 4929 - DNA, 30 bp, Artificial Sequence
  Primer
aaactcgagccatcctacgccagataatcg

SEQ ID NO: 4930 - DNA, 34 bp, Artificial Sequence
  Primer
aaactcgagctagatggaggaaatgcttctgttc

SEQ ID NO: 4931 - DNA, 31 bp, Artificial Sequence
  Primer
aaactcgagctgtgctgacttcattggagag

SEQ ID NO: 4932 - DNA, 31 bp, Artificial Sequence
  Primer
aaactcgagcttctggtagcgacaactttgg

SEQ ID NO: 4933 - DNA, 31 bp, Artificial Sequence
  Primer
aaactcgaggattccttacacgctaagccac

SEQ ID NO: 4934 - DNA, 28 bp, Artificial Sequence
  Primer
aaactcgagggtggacatggtgttcgtc

SEQ ID NO: 4935 - DNA, 31 bp, Artificial Sequence
  Primer
aaactcgaggtgctaccatccaaatcgaatc

SEQ ID NO: 4936 - DNA, 29 bp, Artificial Sequence
  Primer
aaactcgagtagccatgacgatgaagtcc

SEQ ID NO: 4937 - DNA, 32 bp, Artificial Sequence
  Primer
aaactcgagtctatcaagctaccatgctcagg

SEQ ID NO: 4938 - DNA, 31 bp, Artificial Sequence
  Primer
aaactcgagttagctcgctttgcttgtagtg

SEQ ID NO: 4939 - DNA, 37 bp, Artificial Sequence
  Primer
aaactcgagttgagattactactttactagacggtga

SEQ ID NO: 4940 - DNA, 31 bp, Artificial Sequence
  Primer
aaagaattcaaagagcatggctcagtttcag

SEQ ID NO: 4941 - DNA, 31 bp, Artificial Sequence
  Primer
aaagaattcaaataggtggcaggtactccag

SEQ ID NO: 4942 - DNA, 31 bp, Artificial Sequence
  Primer
aaagaattcaacacaatcgtgaatggaacag

SEQ ID NO: 4943 - DNA, 31 bp, Artificial Sequence
  Primer
aaagaattcacaggtctatgcaccatcattg

SEQ ID NO: 4944 - DNA, 31 bp, Artificial Sequence
  Primer
aaagaattcacagtgaaagaagatgcccaag

SEQ ID NO: 4945 - DNA, 31 bp, Artificial Sequence
  Primer
aaagaattcaccctttctgctgaaaccctac

SEQ ID NO: 4946 - DNA, 31 bp, Artificial Sequence
  Primer
aaagaattcacgcagatcctagggaacctac

SEQ ID NO: 4947 - DNA, 31 bp, Artificial Sequence
  Primer
aaagaattcactacgggtaaacatcagccag

SEQ ID NO: 4948 - DNA, 31 bp, Artificial Sequence
  Primer
aaagaattcagtcgggtgcgtctatgattac

SEQ ID NO: 4949 - DNA, 31 bp, Artificial Sequence
  Primer
aaagaattcataccggatccaattaacggac

SEQ ID NO: 4950 - DNA, 31 bp, Artificial Sequence
  Primer
aaagaattcatatgctacgtggtgattgtgc

SEQ ID NO: 4951 - DNA, 37 bp, Artificial Sequence
  Primer
aaagaattcatcgtgtatcctgtattcctatagcatt

SEQ ID NO: 4952 - DNA, 31 bp, Artificial Sequence
  Primer
aaagaattcatggaagaagccaagccagacg

SEQ ID NO: 4953 - DNA, 31 bp, Artificial Sequence
  Primer
aaagaattcattacacatcctctgctcccac

SEQ ID NO: 4954 - DNA, 31 bp, Artificial Sequence
  Primer
aaagaattcattcatccatccatcctacagc

SEQ ID NO: 4955 - DNA, 29 bp, Artificial Sequence
  Primer
aaagaattcattgccgctcgatgtttatc

SEQ ID NO: 4956 - DNA, 31 bp, Artificial Sequence
  Primer
aaagaattccaaatcaattcatggacgagtg

SEQ ID NO: 4957 - DNA, 31 bp, Artificial Sequence
  Primer
aaagaattccaagaggtcaacacatttcacg

SEQ ID NO: 4958 - DNA, 35 bp, Artificial Sequence
  Primer
aaagaattccagaaacacatagaactgttgcattc

SEQ ID NO: 4959 - DNA, 31 bp, Artificial Sequence
  Primer
aaagaattccagcactcatcaaccaagtagc

SEQ ID NO: 4960 - DNA, 34 bp, Artificial Sequence
  Primer
aaagaattccagcagcacttgttactacattgtc

SEQ ID NO: 4961 - DNA, 31 bp, Artificial Sequence
  Primer
aaagaattccagcgtacactcggtaacaaac

SEQ ID NO: 4962 - DNA, 31 bp, Artificial Sequence
  Primer
aaagaattccatcctacagcgcttccattac

SEQ ID NO: 4963 - DNA, 31 bp, Artificial Sequence
  Primer
aaagaattccatgacaagtggtctccgtatg

SEQ ID NO: 4964 - DNA, 31 bp, Artificial Sequence
  Primer
aaagaattccattcgatcattaagcctttgg

SEQ ID NO: 4965 - DNA, 31 bp, Artificial Sequence
  Primer
aaagaattcccatcagaaatcgaaaccgtag

SEQ ID NO: 4966 - DNA, 31 bp, Artificial Sequence
  Primer
aaagaattcccatgactttcatgagcagaag

SEQ ID NO: 4967 - DNA, 34 bp, Artificial Sequence
  Primer
aaagaattcccctgacagagacactacagtacac

SEQ ID NO: 4968 - DNA, 31 bp, Artificial Sequence
  Primer
aaagaattccctcgcttgttatccagatgtc

SEQ ID NO: 4969 - DNA, 31 bp, Artificial Sequence
  Primer
aaagaattccctctgaggaaacactcctgtc

SEQ ID NO: 4970 - DNA, 30 bp, Artificial Sequence
  Primer
aaagaattccgactaacttcagccacgttg

SEQ ID NO: 4971 - DNA, 34 bp, Artificial Sequence
  Primer
aaagaattcctaagcaagagctaccttcctcaac

SEQ ID NO: 4972 - DNA, 34 bp, Artificial Sequence
  Primer
aaagaattcctaagctcttcgatatgagctcgac

SEQ ID NO: 4973 - DNA, 35 bp, Artificial Sequence
  Primer
aaagaattcctaatccaaacccaaattcttgctac

SEQ ID NO: 4974 - DNA, 34 bp, Artificial Sequence
  Primer
aaagaattcctacaatacatcacaaacaggcgtc

SEQ ID NO: 4975 - DNA, 33 bp, Artificial Sequence
  Primer
aaagaattcctacctctgcaatagatgagcgtc

SEQ ID NO: 4976 - DNA, 35 bp, Artificial Sequence
  Primer
aaagaattcctacgcatgagcttggagataagtag

SEQ ID NO: 4977 - DNA, 31 bp, Artificial Sequence
  Primer
aaagaattcctagtcagagcaggagagcacc

SEQ ID NO: 4978 - DNA, 32 bp, Artificial Sequence
  Primer
aaagaattcctagtcagcccactagtcagagc

SEQ ID NO: 4979 - DNA, 33 bp, Artificial Sequence
  Primer
aaagaattcctatacatacaccaccgtgtgcag

SEQ ID NO: 4980 - DNA, 35 bp, Artificial Sequence
  Primer
aaagaattcctatcagcttcggactctcttaactg

SEQ ID NO: 4981 - DNA, 37 bp, Artificial Sequence
  Primer
aaagaattcctatcttacatccaacttatgcacaatc

SEQ ID NO: 4982 - DNA, 30 bp, Artificial Sequence
  Primer
aaagaattcctcttggagttttggtcatgg

SEQ ID NO: 4983 - DNA, 25 bp, Artificial Sequence
  Primer
aaagaattcctgagacgcgacacgc

SEQ ID NO: 4984 - DNA, 31 bp, Artificial Sequence
  Primer
aaagaattccttgcaggacacaagcctaaac

SEQ ID NO: 4985 - DNA, 31 bp, Artificial Sequence
  Primer
aaagaattcggaatgtaggtgtttggtttgc

SEQ ID NO: 4986 - DNA, 37 bp, Artificial Sequence
  Primer
aaagaattcggtatgtagtattatgccaccagacaag

SEQ ID NO: 4987 - DNA, 31 bp, Artificial Sequence
  Primer
aaagaattcgtcggtgagattattgcacctc

SEQ ID NO: 4988 - DNA, 29 bp, Artificial Sequence
  Primer
aaagaattcgtctctgttcccgtgcactc

SEQ ID NO: 4989 - DNA, 31 bp, Artificial Sequence
  Primer
aaagaattcgtcttcatttcacttgacgctg

SEQ ID NO: 4990 - DNA, 29 bp, Artificial Sequence
  Primer
aaagaattcgttcccgtgcactcagactc

SEQ ID NO: 4991 - DNA, 31 bp, Artificial Sequence
  Primer
aaagaattcgttgcattcaacaaagatgcac

SEQ ID NO: 4992 - DNA, 31 bp, Artificial Sequence
  Primer
aaagaattctatccctatctgcacatgctcc

SEQ ID NO: 4993 - DNA, 31 bp, Artificial Sequence
  Primer
aaagaattctcacaaatgcatacgcgtcaac

SEQ ID NO: 4994 - DNA, 29 bp, Artificial Sequence
  Primer
aaagaattctcggttcggcttcaccttac

SEQ ID NO: 4995 - DNA, 31 bp, Artificial Sequence
  Primer
aaagaattctggagcaagtacactctggatg

SEQ ID NO: 4996 - DNA, 32 bp, Artificial Sequence
  Primer
aaagaattcttacatatctgtggatgtggctg

SEQ ID NO: 4997 - DNA, 36 bp, Artificial Sequence
  Primer
aaagaattcttggagtaccaaacaaaattcataaac

SEQ ID NO: 4998 - DNA, 31 bp, Artificial Sequence
  Primer
aaagaattcttgtgatgctttacactgcaac

SEQ ID NO: 4999 - DNA, 34 bp, Artificial Sequence
  Primer
aaagagctcaaacttctggatgtgacccttactg

SEQ ID NO: 5000 - DNA, 31 bp, Artificial Sequence
  Primer
aaagatatcaacatacgacgcacaagagatg

SEQ ID NO: 5001 - DNA, 31 bp, Artificial Sequence
  Primer
aaagatatcatcatattcccacttggtgctg

SEQ ID NO: 5002 - DNA, 31 bp, Artificial Sequence
  Primer
aaagatatcatcggagaccacgtacactacc

SEQ ID NO: 5003 - DNA, 31 bp, Artificial Sequence
  Primer
aaagatatcatcttgtcgcattacatcatgg

SEQ ID NO: 5004 - DNA, 28 bp, Artificial Sequence
  Primer
aaagatatccgtggtatgtgccatgagg

SEQ ID NO: 5005 - DNA, 34 bp, Artificial Sequence
  Primer
aaagatatcctaaaacctacaacatgctccagtg

SEQ ID NO: 5006 - DNA, 34 bp, Artificial Sequence
  Primer
aaagatatcctagttggtgtcacttgtcagaacc

SEQ ID NO: 5007 - DNA, 34 bp, Artificial Sequence
  Primer
aaagatatcctatgaagctctgggtgaatttgtc

SEQ ID NO: 5008 - DNA, 28 bp, Artificial Sequence
  Primer
aaagatatcctctgatgatgaagcaccc

SEQ ID NO: 5009 - DNA, 32 bp, Artificial Sequence
  Primer
aaagatatcgcatgctttctagcattagttgg

SEQ ID NO: 5010 - DNA, 31 bp, Artificial Sequence
  Primer
aaagatatcgctcacagaatgtctcagcaac

SEQ ID NO: 5011 - DNA, 34 bp, Artificial Sequence
  Primer
aaagatatctagagtagctctgatgatgaagcac

SEQ ID NO: 5012 - DNA, 31 bp, Artificial Sequence
  Primer
aaagatatctctaagccgctctttcattgtc

SEQ ID NO: 5013 - DNA, 31 bp, Artificial Sequence
  Primer
aaagatatctgaatttgatctcacgagcaac

SEQ ID NO: 5014 - DNA, 31 bp, Artificial Sequence
  Primer
aaagatatcttacaaacaagacggaacatgg

SEQ ID NO: 5015 - DNA, 31 bp, Artificial Sequence
  Primer
aaagatatcttggcagagaacaagcatactg

SEQ ID NO: 5016 - DNA, 31 bp, Artificial Sequence
  Primer
aaaggatccaaaacccatccaaagaccaaac

SEQ ID NO: 5017 - DNA, 31 bp, Artificial Sequence
  Primer
aaaggatccaaacaaatcactcgagcaaagg

SEQ ID NO: 5018 - DNA, 28 bp, Artificial Sequence
  Primer
aaaggatccaaaccttcgcttcgtctcg

SEQ ID NO: 5019 - DNA, 32 bp, Artificial Sequence
  Primer
aaaggatccaaacgagatcagtgaatcctacg

SEQ ID NO: 5020 - DNA, 31 bp, Artificial Sequence
  Primer
aaaggatccaaagctaagctcagccagagtc

SEQ ID NO: 5021 - DNA, 35 bp, Artificial Sequence
  Primer
aaaggatccaaataaagagagagtaccaagcaagc

SEQ ID NO: 5022 - DNA, 28 bp, Artificial Sequence
  Primer
aaaggatccaacaggaagcagcagggtg

SEQ ID NO: 5023 - DNA, 28 bp, Artificial Sequence
  Primer
aaaggatccaacatagggtttgcggctc

SEQ ID NO: 5024 - DNA, 31 bp, Artificial Sequence
  Primer
aaaggatccaagatcagagcatctccgtgtc

SEQ ID NO: 5025 - DNA, 29 bp, Artificial Sequence
  Primer
aaaggatccaagcctgtatccgtctgtcg

SEQ ID NO: 5026 - DNA, 30 bp, Artificial Sequence
  Primer
aaaggatccaagtgcagaggcaaagttgtg

SEQ ID NO: 5027 - DNA, 28 bp, Artificial Sequence
  Primer
aaaggatccaattgttcaggggacggag

SEQ ID NO: 5028 - DNA, 31 bp, Artificial Sequence
  Primer
aaaggatccacagagagatccctagctgcac

SEQ ID NO: 5029 - DNA, 28 bp, Artificial Sequence
  Primer
aaaggatccacagcctcgcctttgattg

SEQ ID NO: 5030 - DNA, 30 bp, Artificial Sequence
  Primer
aaaggatccacagtggttgttggattggag

SEQ ID NO: 5031 - DNA, 28 bp, Artificial Sequence
  Primer
aaaggatccaccaccataagcaccaacg

SEQ ID NO: 5032 - DNA, 27 bp, Artificial Sequence
  Primer
aaaggatccaccacctaccatggcgac

SEQ ID NO: 5033 - DNA, 28 bp, Artificial Sequence
  Primer
aaaggatccacccagtccaaccaaatcg

SEQ ID NO: 5034 - DNA, 30 bp, Artificial Sequence
  Primer
aaaggatccacccatagtctttctcgcagc

SEQ ID NO: 5035 - DNA, 31 bp, Artificial Sequence
  Primer
aaaggatccacctcatgtcctcatcatcatc

SEQ ID NO: 5036 - DNA, 30 bp, Artificial Sequence
  Primer
aaaggatccacgcaagaagaacagtggttg

SEQ ID NO: 5037 - DNA, 25 bp, Artificial Sequence
  Primer
aaaggatccacgcctccgtcctgtc

SEQ ID NO: 5038 - DNA, 31 bp, Artificial Sequence
  Primer
aaaggatccacgctaatcccttcctttcctc

SEQ ID NO: 5039 - DNA, 29 bp, Artificial Sequence
  Primer
aaaggatccactcccaaaccctagcaacc

SEQ ID NO: 5040 - DNA, 29 bp, Artificial Sequence
  Primer
aaaggatccactcctcagctccgaccttc

SEQ ID NO: 5041 - DNA, 31 bp, Artificial Sequence
  Primer
aaaggatccacttgttatgcctgccactttg

SEQ ID NO: 5042 - DNA, 31 bp, Artificial Sequence
  Primer
aaaggatccagaaacgttgagacagggagag

SEQ ID NO: 5043 - DNA, 28 bp, Artificial Sequence
  Primer
aaaggatccagaaggaaaagggggaacc

SEQ ID NO: 5044 - DNA, 31 bp, Artificial Sequence
  Primer
aaaggatccagaatcagcttgcacacgtacc

SEQ ID NO: 5045 - DNA, 29 bp, Artificial Sequence
  Primer
aaaggatccagagcacaagcgagcaagtc

SEQ ID NO: 5046 - DNA, 31 bp, Artificial Sequence
  Primer
aaaggatccagcacatctcctcctcataacc

SEQ ID NO: 5047 - DNA, 30 bp, Artificial Sequence
  Primer
aaaggatccagcctctagaaccttccggtc

SEQ ID NO: 5048 - DNA, 31 bp, Artificial Sequence
  Primer
aaaggatccagcgaggaatctagtccagtcc

SEQ ID NO: 5049 - DNA, 27 bp, Artificial Sequence
  Primer
aaaggatccagcggctccaagattgac

SEQ ID NO: 5050 - DNA, 30 bp, Artificial Sequence
  Primer
aaaggatccagctccgtctcaaggataacg

SEQ ID NO: 5051 - DNA, 31 bp, Artificial Sequence
  Primer
aaaggatccagcttcgtctggttgaattctc

SEQ ID NO: 5052 - DNA, 29 bp, Artificial Sequence
  Primer
aaaggatccaggggttgattcagagatgc

SEQ ID NO: 5053 - DNA, 31 bp, Artificial Sequence
  Primer
aaaggatccagtagcaggttgcattgttcac

SEQ ID NO: 5054 - DNA, 30 bp, Artificial Sequence
  Primer
aaaggatccagtccgggacatcacagctac

SEQ ID NO: 5055 - DNA, 28 bp, Artificial Sequence
  Primer
aaaggatccagtctccacgctttccgtc

SEQ ID NO: 5056 - DNA, 30 bp, Artificial Sequence
  Primer
aaaggatccataagaagcggcagaaccctc

SEQ ID NO: 5057 - DNA, 31 bp, Artificial Sequence
  Primer
aaaggatccataatgatgtccagagccaagg

SEQ ID NO: 5058 - DNA, 31 bp, Artificial Sequence
  Primer
aaaggatccatatcgtcccttccagtgtacc

SEQ ID NO: 5059 - DNA, 31 bp, Artificial Sequence
  Primer
aaaggatccatcctcaaggaatgaacacagc

SEQ ID NO: 5060 - DNA, 31 bp, Artificial Sequence
  Primer
aaaggatccatcgacctcatgtcctcatcat

SEQ ID NO: 5061 - DNA, 29 bp, Artificial Sequence
  Primer
aaaggatccatctcaccaccgttcactgc

SEQ ID NO: 5062 - DNA, 31 bp, Artificial Sequence
  Primer
aaaggatccatgtggatgctctgaactgatg

SEQ ID NO: 5063 - DNA, 31 bp, Artificial Sequence
  Primer
aaaggatccattagacctggactgttgccag

SEQ ID NO: 5064 - DNA, 31 bp, Artificial Sequence
  Primer
aaaggatcccaaaccccgtgtacaataagtg

SEQ ID NO: 5065 - DNA, 32 bp, Artificial Sequence
  Primer
aaaggatcccaaaggtacaattggcatgaaac

SEQ ID NO: 5066 - DNA, 31 bp, Artificial Sequence
  Primer
aaaggatcccaacagaacgagcccttaacag

SEQ ID NO: 5067 - DNA, 31 bp, Artificial Sequence
  Primer
aaaggatcccaacctaccacatggctgtatg

SEQ ID NO: 5068 - DNA, 31 bp, Artificial Sequence
  Primer
aaaggatcccaagaatcgctcctctcagttc

SEQ ID NO: 5069 - DNA, 31 bp, Artificial Sequence
  Primer
aaaggatcccaaggctggaagtaccaaattc

SEQ ID NO: 5070 - DNA, 29 bp, Artificial Sequence
  Primer
aaaggatcccaatcgcagagaagaggcag

SEQ ID NO: 5071 - DNA, 31 bp, Artificial Sequence
  Primer
aaaggatcccaatgttcaatgctggagtcac

SEQ ID NO: 5072 - DNA, 31 bp, Artificial Sequence
  Primer
aaaggatcccaccatcgaaatcatctcacag

SEQ ID NO: 5073 - DNA, 30 bp, Artificial Sequence
  Primer
aaaggatcccacctcctcggctcattctac

SEQ ID NO: 5074 - DNA, 32 bp, Artificial Sequence
  Primer
aaaggatcccaccttacctgctactgatctgc

SEQ ID NO: 5075 - DNA, 28 bp, Artificial Sequence
  Primer
aaaggatcccagccacacctacccgttc

SEQ ID NO: 5076 - DNA, 32 bp, Artificial Sequence
  Primer
aaaggatcccagtgcagcccatcatactttag

SEQ ID NO: 5077 - DNA, 33 bp, Artificial Sequence
  Primer
aaaggatcccatcacataatgtaggagagcgag

SEQ ID NO: 5078 - DNA, 27 bp, Artificial Sequence
  Primer
aaaggatcccatcagcagcttcccctc

SEQ ID NO: 5079 - DNA, 30 bp, Artificial Sequence
  Primer
aaaggatcccatcctctctcgcacacagac

SEQ ID NO: 5080 - DNA, 31 bp, Artificial Sequence
  Primer
aaaggatccccagaaattgttgtcaggaagg

SEQ ID NO: 5081 - DNA, 31 bp, Artificial Sequence
  Primer
aaaggatcccccaaagctacaacttgagcac

SEQ ID NO: 5082 - DNA, 29 bp, Artificial Sequence
  Primer
aaaggatcccccatcaccaaaaccctagc

SEQ ID NO: 5083 - DNA, 32 bp, Artificial Sequence
  Primer
aaaggatcccccatcaccattagtgaaacaac

SEQ ID NO: 5084 - DNA, 27 bp, Artificial Sequence
  Primer
aaaggatcccccatcgaaacgcttgtg

SEQ ID NO: 5085 - DNA, 28 bp, Artificial Sequence
  Primer
aaaggatccccgttcggcaaagatgaag

SEQ ID NO: 5086 - DNA, 31 bp, Artificial Sequence
  Primer
aaaggatcccctcaaagcagagaccctactg

SEQ ID NO: 5087 - DNA, 32 bp, Artificial Sequence
  Primer
aaaggatcccctcttaacgagaacgcagagtc

SEQ ID NO: 5088 - DNA, 32 bp, Artificial Sequence
  Primer
aaaggatcccctgtatccaaggagagaaatcc

SEQ ID NO: 5089 - DNA, 32 bp, Artificial Sequence
  Primer
aaaggatccccttaccctaccctaccagatcg

SEQ ID NO: 5090 - DNA, 31 bp, Artificial Sequence
  Primer
aaaggatccccttcctaaaccctagccagac

SEQ ID NO: 5091 - DNA, 30 bp, Artificial Sequence
  Primer
aaaggatcccctttcgtcctcaccagagac

SEQ ID NO: 5092 - DNA, 29 bp, Artificial Sequence
  Primer
aaaggatcccgaaaggggttgattcagag

SEQ ID NO: 5093 - DNA, 31 bp, Artificial Sequence
  Primer
aaaggatcccgaagaaacactccaagaaacc

SEQ ID NO: 5094 - DNA, 30 bp, Artificial Sequence
  Primer
aaaggatcccgacacttcctccaagacctc

SEQ ID NO: 5095 - DNA, 31 bp, Artificial Sequence
  Primer
aaaggatcccgagaacccgagtctatttctg

SEQ ID NO: 5096 - DNA, 33 bp, Artificial Sequence
  Primer
aaaggatcccgagactccattcattcctagaag

SEQ ID NO: 5097 - DNA, 31 bp, Artificial Sequence
  Primer
aaaggatcccgaggaacaagtccaacagaac

SEQ ID NO: 5098 - DNA, 28 bp, Artificial Sequence
  Primer
aaaggatcccgcaattaacacctcctgc

SEQ ID NO: 5099 - DNA, 27 bp, Artificial Sequence
  Primer
aaaggatcccggagctggtctttgctc

SEQ ID NO: 5100 - DNA, 28 bp, Artificial Sequence
  Primer
aaaggatcccggaggaggaagaggaatg

SEQ ID NO: 5101 - DNA, 29 bp, Artificial Sequence
  Primer
aaaggatcccggcagattgattcgatttc

SEQ ID NO: 5102 - DNA, 29 bp, Artificial Sequence
  Primer
aaaggatcccgtaccaccggatttctgtc

SEQ ID NO: 5103 - DNA, 31 bp, Artificial Sequence
  Primer
aaaggatccctacgtaccgtacctgcctagc

SEQ ID NO: 5104 - DNA, 35 bp, Artificial Sequence
  Primer
aaaggatccctagccgtattctgaagttatcgctc

SEQ ID NO: 5105 - DNA, 34 bp, Artificial Sequence
  Primer
aaaggatccctatgaatgtatcaatgcggaagag

SEQ ID NO: 5106 - DNA, 34 bp, Artificial Sequence
  Primer
aaaggatccctatgcggaagagatgaacagatag

SEQ ID NO: 5107 - DNA, 28 bp, Artificial Sequence
  Primer
aaaggatccctcagagccagacaccagc

SEQ ID NO: 5108 - DNA, 31 bp, Artificial Sequence
  Primer
aaaggatccctcattagctcttgaccggaag

SEQ ID NO: 5109 - DNA, 31 bp, Artificial Sequence
  Primer
aaaggatccctccactccagttcttgtctcc

SEQ ID NO: 5110 - DNA, 31 bp, Artificial Sequence
  Primer
aaaggatccctcctgttctcgattctcgaag

SEQ ID NO: 5111 - DNA, 29 bp, Artificial Sequence
  Primer
aaaggatccctcgtttcggattgcatttg

SEQ ID NO: 5112 - DNA, 30 bp, Artificial Sequence
  Primer
aaaggatccctcttcttcaaccttccgctg

SEQ ID NO: 5113 - DNA, 31 bp, Artificial Sequence
  Primer
aaaggatccctctttccagagcagagcagac

SEQ ID NO: 5114 - DNA, 31 bp, Artificial Sequence
  Primer
aaaggatccctctttgctggtaaggaagctc

SEQ ID NO: 5115 - DNA, 30 bp, Artificial Sequence
  Primer
aaaggatccctgagtgctgagttgttgacc

SEQ ID NO: 5116 - DNA, 31 bp, Artificial Sequence
  Primer
aaaggatccctgattggcaacacaactcaag

SEQ ID NO: 5117 - DNA, 31 bp, Artificial Sequence
  Primer
aaaggatccctgcacagctctgactctaagg

SEQ ID NO: 5118 - DNA, 30 bp, Artificial Sequence
  Primer
aaaggatccctgctgcagagctaaccaatg

SEQ ID NO: 5119 - DNA, 27 bp, Artificial Sequence
  Primer
aaaggatccctgctgcggacgtacctc

SEQ ID NO: 5120 - DNA, 31 bp, Artificial Sequence
  Primer
aaaggatccctggaagtttgatggtgtgatg

SEQ ID NO: 5121 - DNA, 29 bp, Artificial Sequence
  Primer
aaaggatccctgtgacctggaagctctgg

SEQ ID NO: 5122 - DNA, 30 bp, Artificial Sequence
  Primer
aaaggatccctgttccgaccagagagagag

SEQ ID NO: 5123 - DNA, 31 bp, Artificial Sequence
  Primer
aaaggatcccttcctcaagctcaagcagaac

SEQ ID NO: 5124 - DNA, 27 bp, Artificial Sequence
  Primer
aaaggatcccttcgtcgctcggtgaac

SEQ ID NO: 5125 - DNA, 28 bp, Artificial Sequence
  Primer
aaaggatcccttcttgaggcgcttctcc

SEQ ID NO: 5126 - DNA, 33 bp, Artificial Sequence
  Primer
aaaggatcccttgaagtgttgagattgagggag

SEQ ID NO: 5127 - DNA, 31 bp, Artificial Sequence
  Primer
aaaggatcccttggttaaggaagctgactgc

SEQ ID NO: 5128 - DNA, 31 bp, Artificial Sequence
  Primer
aaaggatccctttccatcataaacagcccac

SEQ ID NO: 5129 - DNA, 31 bp, Artificial Sequence
  Primer
aaaggatccctttccattcagtagcgtggag

SEQ ID NO: 5130 - DNA, 30 bp, Artificial Sequence
  Primer
aaaggatccgaaaggagacctcagaggcag

SEQ ID NO: 5131 - DNA, 31 bp, Artificial Sequence
  Primer
aaaggatccgaactgatgcaggaggaagaag

SEQ ID NO: 5132 - DNA, 31 bp, Artificial Sequence
  Primer
aaaggatccgaacttcagaagacgccatttc

SEQ ID NO: 5133 - DNA, 30 bp, Artificial Sequence
  Primer
aaaggatccgacagctcccgttctcttctc

SEQ ID NO: 5134 - DNA, 31 bp, Artificial Sequence
  Primer
aaaggatccgacgagatcttgcactagatgg

SEQ ID NO: 5135 - DNA, 29 bp, Artificial Sequence
  Primer
aaaggatccgacgagcatcaccaggtttc

SEQ ID NO: 5136 - DNA, 31 bp, Artificial Sequence
  Primer
aaaggatccgagactacgctaggtcgagcac

SEQ ID NO: 5137 - DNA, 30 bp, Artificial Sequence
  Primer
aaaggatccgagagaaatccagaggcgaag

SEQ ID NO: 5138 - DNA, 30 bp, Artificial Sequence
  Primer
aaaggatccgagagcgagcatgactctacc

SEQ ID NO: 5139 - DNA, 33 bp, Artificial Sequence
  Primer
aaaggatccgagcacacgaccaaagtacactac

SEQ ID NO: 5140 - DNA, 31 bp, Artificial Sequence
  Primer
aaaggatccgatgtttctctgctccgacttc

SEQ ID NO: 5141 - DNA, 30 bp, Artificial Sequence
  Primer
aaaggatccgattgctccgagggttagttc

SEQ ID NO: 5142 - DNA, 29 bp, Artificial Sequence
  Primer
aaaggatccgcagagctaaccaatggacg

SEQ ID NO: 5143 - DNA, 28 bp, Artificial Sequence
  Primer
aaaggatccgcagcaccagagctagtcg

SEQ ID NO: 5144 - DNA, 29 bp, Artificial Sequence
  Primer
aaaggatccgccacctaatcctctggagc

SEQ ID NO: 5145 - DNA, 29 bp, Artificial Sequence
  Primer
aaaggatccgcccttctacagaaccgacc

SEQ ID NO: 5146 - DNA, 31 bp, Artificial Sequence
  Primer
aaaggatccgccgtgtaaacccataaagttc

SEQ ID NO: 5147 - DNA, 29 bp, Artificial Sequence
  Primer
aaaggatccgcgcacccatagtctttctc

SEQ ID NO: 5148 - DNA, 31 bp, Artificial Sequence
  Primer
aaaggatccgcgcttctacttcttcctcaag

SEQ ID NO: 5149 - DNA, 31 bp, Artificial Sequence
  Primer
aaaggatccgcggagaaagcaagtaatatcg

SEQ ID NO: 5150 - DNA, 30 bp, Artificial Sequence
  Primer
aaaggatccgcggattcactctctctctcc

SEQ ID NO: 5151 - DNA, 32 bp, Artificial Sequence
  Primer
aaaggatccgcgtagaggtgagatttgtgaag

SEQ ID NO: 5152 - DNA, 27 bp, Artificial Sequence
  Primer
aaaggatccgctcagctccgaccgacc

SEQ ID NO: 5153 - DNA, 29 bp, Artificial Sequence
  Primer
aaaggatccggaacccaaagagaggttgc

SEQ ID NO: 5154 - DNA, 31 bp, Artificial Sequence
  Primer
aaaggatccggacgaaaccctaatggagaac

SEQ ID NO: 5155 - DNA, 30 bp, Artificial Sequence
  Primer
aaaggatccggactgccatagcttcctagc

SEQ ID NO: 5156 - DNA, 31 bp, Artificial Sequence
  Primer
aaaggatccggctcatctctgattatggagg

SEQ ID NO: 5157 - DNA, 31 bp, Artificial Sequence
  Primer
aaaggatccggctgagagcaaagattgtagc

SEQ ID NO: 5158 - DNA, 29 bp, Artificial Sequence
  Primer
aaaggatccgggaagtccagtacccaagc

SEQ ID NO: 5159 - DNA, 31 bp, Artificial Sequence
  Primer
aaaggatccgggagcgtatacgaggtagagg

SEQ ID NO: 5160 - DNA, 31 bp, Artificial Sequence
  Primer
aaaggatccgtacgagggaaatccaagaagg

SEQ ID NO: 5161 - DNA, 29 bp, Artificial Sequence
  Primer
aaaggatccgtccgagtctccgaggaaag

SEQ ID NO: 5162 - DNA, 31 bp, Artificial Sequence
  Primer
aaaggatccgtcctccagcccattatacatc

SEQ ID NO: 5163 - DNA, 27 bp, Artificial Sequence
  Primer
aaaggatccgtcttccttcgccgcttc

SEQ ID NO: 5164 - DNA, 31 bp, Artificial Sequence
  Primer
aaaggatccgtgaatcctacggctattccag

SEQ ID NO: 5165 - DNA, 27 bp, Artificial Sequence
  Primer
aaaggatccgtgcaagaaagatgcggc

SEQ ID NO: 5166 - DNA, 31 bp, Artificial Sequence
  Primer
aaaggatccgtgcgtacaattcacaatcgac

SEQ ID NO: 5167 - DNA, 31 bp, Artificial Sequence
  Primer
aaaggatccgtggagatcaaactagccaagg

SEQ ID NO: 5168 - DNA, 29 bp, Artificial Sequence
  Primer
aaaggatccgtgtccgtccggtgagatag

SEQ ID NO: 5169 - DNA, 31 bp, Artificial Sequence
  Primer
aaaggatccgttccaatcgacagtttgacac

SEQ ID NO: 5170 - DNA, 27 bp, Artificial Sequence
  Primer
aaaggatccgttggtggtggggatgag

SEQ ID NO: 5171 - DNA, 34 bp, Artificial Sequence
  Primer
aaaggatccgtttcttgaagtgttgagattgagg

SEQ ID NO: 5172 - DNA, 30 bp, Artificial Sequence
  Primer
aaaggatccgtttctttcagctcgggagag

SEQ ID NO: 5173 - DNA, 30 bp, Artificial Sequence
  Primer
aaaggatccgtttggacttcattcgggaag

SEQ ID NO: 5174 - DNA, 31 bp, Artificial Sequence
  Primer
aaaggatcctaatattcgtcgttcgggtagg

SEQ ID NO: 5175 - DNA, 30 bp, Artificial Sequence
  Primer
aaaggatcctacgcactagccacacagtcc

SEQ ID NO: 5176 - DNA, 31 bp, Artificial Sequence
  Primer
aaaggatcctaggccttgtccattaaggctc

SEQ ID NO: 5177 - DNA, 30 bp, Artificial Sequence
  Primer
aaaggatcctatacgcccgtttctctctcc

SEQ ID NO: 5178 - DNA, 27 bp, Artificial Sequence
  Primer
aaaggatcctattgctcgacgtttggc

SEQ ID NO: 5179 - DNA, 31 bp, Artificial Sequence
  Primer
aaaggatcctccctctctctggctaaggtag

SEQ ID NO: 5180 - DNA, 31 bp, Artificial Sequence
  Primer
aaaggatcctcgacaatgctactgaagcaag

SEQ ID NO: 5181 - DNA, 31 bp, Artificial Sequence
  Primer
aaaggatcctcgtccttgtttacatcagcag

SEQ ID NO: 5182 - DNA, 34 bp, Artificial Sequence
  Primer
aaaggatcctctcaatatctcatcagtcatcacc

SEQ ID NO: 5183 - DNA, 31 bp, Artificial Sequence
  Primer
aaaggatcctctggccactattgaaagaagc

SEQ ID NO: 5184 - DNA, 30 bp, Artificial Sequence
  Primer
aaaggatcctctttctctccctgccaaatc

SEQ ID NO: 5185 - DNA, 32 bp, Artificial Sequence
  Primer
aaaggatcctgaagtgagttgtggcactaaag

SEQ ID NO: 5186 - DNA, 27 bp, Artificial Sequence
  Primer
aaaggatcctgagttcctggcggaatg

SEQ ID NO: 5187 - DNA, 33 bp, Artificial Sequence
  Primer
aaaggatcctgagttctctagcaccttacctgc

SEQ ID NO: 5188 - DNA, 31 bp, Artificial Sequence
  Primer
aaaggatcctgatcagcagattgccataatc

SEQ ID NO: 5189 - DNA, 31 bp, Artificial Sequence
  Primer
aaaggatcctgcagcaagatttgcataacac

SEQ ID NO: 5190 - DNA, 31 bp, Artificial Sequence
  Primer
aaaggatcctgcatataatcccaagctcctc

SEQ ID NO: 5191 - DNA, 31 bp, Artificial Sequence
  Primer
aaaggatcctgctaaagcctaagcatgtgtg

SEQ ID NO: 5192 - DNA, 31 bp, Artificial Sequence
  Primer
aaaggatcctgggttgggttgataacttgag

SEQ ID NO: 5193 - DNA, 31 bp, Artificial Sequence
  Primer
aaaggatcctggtactgttgcggtattctcc

SEQ ID NO: 5194 - DNA, 31 bp, Artificial Sequence
  Primer
aaaggatcctgtcctaaatacgctcctctcc

SEQ ID NO: 5195 - DNA, 31 bp, Artificial Sequence
  Primer
aaaggatcctgtcgcgttagcttctcacttc

SEQ ID NO: 5196 - DNA, 31 bp, Artificial Sequence
  Primer
aaaggatcctgtcgttcccagtttagaggag

SEQ ID NO: 5197 - DNA, 27 bp, Artificial Sequence
  Primer
aaaggatcctgtgtgatggcggagagg

SEQ ID NO: 5198 - DNA, 29 bp, Artificial Sequence
  Primer
aaaggatcctgttgcggaagataggtgtg

SEQ ID NO: 5199 - DNA, 31 bp, Artificial Sequence
  Primer
aaaggatccttagcatcagacttgcttgacg

SEQ ID NO: 5200 - DNA, 30 bp, Artificial Sequence
  Primer
aaaggatccttattggcatctctctccgtc

SEQ ID NO: 5201 - DNA, 30 bp, Artificial Sequence
  Primer
aaaggatccttgatcagtccatcccatctc

SEQ ID NO: 5202 - DNA, 31 bp, Artificial Sequence
  Primer
aaaggtaccaaacactgaatcaactgcaacg

SEQ ID NO: 5203 - DNA, 28 bp, Artificial Sequence
  Primer
aaaggtaccaaactgagaccggtggtgg

SEQ ID NO: 5204 - DNA, 31 bp, Artificial Sequence
  Primer
aaaggtaccaaactgcacatgatcccttctc

SEQ ID NO: 5205 - DNA, 31 bp, Artificial Sequence
  Primer
aaaggtaccaaagaacacctaacgctgatgc

SEQ ID NO: 5206 - DNA, 31 bp, Artificial Sequence
  Primer
aaaggtaccaacaaggccatgatgcttattc

SEQ ID NO: 5207 - DNA, 31 bp, Artificial Sequence
  Primer
aaaggtaccaacactaaaaggttgacgcagc

SEQ ID NO: 5208 - DNA, 31 bp, Artificial Sequence
  Primer
aaaggtaccaacagaaaggtaaacacggctg

SEQ ID NO: 5209 - DNA, 30 bp, Artificial Sequence
  Primer
aaaggtaccaacagccctcagagtcagacc

SEQ ID NO: 5210 - DNA, 39 bp, Artificial Sequence
  Primer
aaaggtaccaacgaaagcgatactatttctattttacaa

SEQ ID NO: 5211 - DNA, 31 bp, Artificial Sequence
  Primer
aaaggtaccaacgtccaagaacatagccaac

SEQ ID NO: 5212 - DNA, 31 bp, Artificial Sequence
  Primer
aaaggtaccaagaacaagcctcaaccacatc

SEQ ID NO: 5213 - DNA, 31 bp, Artificial Sequence
  Primer
aaaggtaccaagcgggatcttattcgaactc

SEQ ID NO: 5214 - DNA, 31 bp, Artificial Sequence
  Primer
aaaggtaccaagctcgggtcttcgtctattc

SEQ ID NO: 5215 - DNA, 31 bp, Artificial Sequence
  Primer
aaaggtaccaattatttggcaactgtggtgg

SEQ ID NO: 5216 - DNA, 31 bp, Artificial Sequence
  Primer
aaaggtaccacaaagcaatgaccttctcagg

SEQ ID NO: 5217 - DNA, 31 bp, Artificial Sequence
  Primer
aaaggtaccacaatgcgagtacatcatcagg

SEQ ID NO: 5218 - DNA, 31 bp, Artificial Sequence
  Primer
aaaggtaccacacattggagctgacaaacac

SEQ ID NO: 5219 - DNA, 31 bp, Artificial Sequence
  Primer
aaaggtaccacagtgcgctagcactacacag

SEQ ID NO: 5220 - DNA, 31 bp, Artificial Sequence
  Primer
aaaggtaccacatcatcaggccgtacaactc

SEQ ID NO: 5221 - DNA, 31 bp, Artificial Sequence
  Primer
aaaggtaccacattcggtacagcattcttcc

SEQ ID NO: 5222 - DNA, 31 bp, Artificial Sequence
  Primer
aaaggtaccaccaggccaagataaagaagtg

SEQ ID NO: 5223 - DNA, 31 bp, Artificial Sequence
  Primer
aaaggtaccacctatcatgccctcatgtacc

SEQ ID NO: 5224 - DNA, 31 bp, Artificial Sequence
  Primer
aaaggtaccacgaccgaacatacaattcagg

SEQ ID NO: 5225 - DNA, 30 bp, Artificial Sequence
  Primer
aaaggtaccacgggtgataaggacaccatc

SEQ ID NO: 5226 - DNA, 31 bp, Artificial Sequence
  Primer
aaaggtaccacggttcagtaaggcagtaacg

SEQ ID NO: 5227 - DNA, 31 bp, Artificial Sequence
  Primer
aaaggtaccacgttgccttatctctgacagc

SEQ ID NO: 5228 - DNA, 31 bp, Artificial Sequence
  Primer
aaaggtaccactcatgccactgtgttattgc

SEQ ID NO: 5229 - DNA, 31 bp, Artificial Sequence
  Primer
aaaggtaccactctggcctgctactacttgg

SEQ ID NO: 5230 - DNA, 31 bp, Artificial Sequence
  Primer
aaaggtaccactgcaacgcaaattgtatgag

SEQ ID NO: 5231 - DNA, 31 bp, Artificial Sequence
  Primer
aaaggtaccagaaatacacacgtctgggctc

SEQ ID NO: 5232 - DNA, 31 bp, Artificial Sequence
  Primer
aaaggtaccagctagacgctatgagccagtg

SEQ ID NO: 5233 - DNA, 31 bp, Artificial Sequence
  Primer
aaaggtaccagctcccaaattaagcacactg

SEQ ID NO: 5234 - DNA, 30 bp, Artificial Sequence
  Primer
aaaggtaccaggttggcagttctgacatca

SEQ ID NO: 5235 - DNA, 31 bp, Artificial Sequence
  Primer
aaaggtaccagtaccatgcaagtctgtgtcg

SEQ ID NO: 5236 - DNA, 31 bp, Artificial Sequence
  Primer
aaaggtaccagtttcctgaaaccatcactgc

SEQ ID NO: 5237 - DNA, 31 bp, Artificial Sequence
  Primer
aaaggtaccatatccatcccgtgataccaac

SEQ ID NO: 5238 - DNA, 31 bp, Artificial Sequence
  Primer
aaaggtaccatcatcacgtacgtagcaccag

SEQ ID NO: 5239 - DNA, 31 bp, Artificial Sequence
  Primer
aaaggtaccatcccacaacgatctcaatacc

SEQ ID NO: 5240 - DNA, 31 bp, Artificial Sequence
  Primer
aaaggtaccatgtcacattgacgagttgagg

SEQ ID NO: 5241 - DNA, 31 bp, Artificial Sequence
  Primer
aaaggtaccattgttacaacacgacagcctc

SEQ ID NO: 5242 - DNA, 31 bp, Artificial Sequence
  Primer
aaaggtacccaaccttgtcaccttcttccac

SEQ ID NO: 5243 - DNA, 35 bp, Artificial Sequence
  Primer
aaaggtacccaactaaatcaagaaacagtctctgc

SEQ ID NO: 5244 - DNA, 36 bp, Artificial Sequence
  Primer
aaaggtacccaagaatcatcttacaacatgcaacta

SEQ ID NO: 5245 - DNA, 31 bp, Artificial Sequence
  Primer
aaaggtacccaatcaaggtaacaacagcagg

SEQ ID NO: 5246 - DNA, 31 bp, Artificial Sequence
  Primer
aaaggtacccaccgtgaatatgatcctctgg

SEQ ID NO: 5247 - DNA, 31 bp, Artificial Sequence
  Primer
aaaggtacccacggaaaactggaaccaatac

SEQ ID NO: 5248 - DNA, 32 bp, Artificial Sequence
  Primer
aaaggtacccagcaaagacatgaatagtgcag

SEQ ID NO: 5249 - DNA, 31 bp, Artificial Sequence
  Primer
aaaggtacccagcatatgagctgatttccac

SEQ ID NO: 5250 - DNA, 31 bp, Artificial Sequence
  Primer
aaaggtacccagcgattctcaatttagctcc

SEQ ID NO: 5251 - DNA, 31 bp, Artificial Sequence
  Primer
aaaggtacccagtgcactactttgcctgatg

SEQ ID NO: 5252 - DNA, 35 bp, Artificial Sequence
  Primer
aaaggtacccataagtcataacatatcgcaggaac

SEQ ID NO: 5253 - DNA, 31 bp, Artificial Sequence
  Primer
aaaggtacccatctcacgacaagtcgacaac

SEQ ID NO: 5254 - DNA, 33 bp, Artificial Sequence
  Primer
aaaggtacccattaaggcataaggtgatggatg

SEQ ID NO: 5255 - DNA, 32 bp, Artificial Sequence
  Primer
aaaggtacccattgaaactacaaagcacccac

SEQ ID NO: 5256 - DNA, 33 bp, Artificial Sequence
  Primer
aaaggtaccccaaactaacccactcaagtaacc

SEQ ID NO: 5257 - DNA, 31 bp, Artificial Sequence
  Primer
aaaggtaccccaaatttacaagaagggcacc

SEQ ID NO: 5258 - DNA, 31 bp, Artificial Sequence
  Primer
aaaggtaccccgatatggaatactctgctcg

SEQ ID NO: 5259 - DNA, 31 bp, Artificial Sequence
  Primer
aaaggtacccctccttcagagtccagatcac

SEQ ID NO: 5260 - DNA, 31 bp, Artificial Sequence
  Primer
aaaggtaccccttgcgagtcaagacatgtag

SEQ ID NO: 5261 - DNA, 33 bp, Artificial Sequence
  Primer
aaaggtacccgcagtagtccatttctatcttgc

SEQ ID NO: 5262 - DNA, 31 bp, Artificial Sequence
  Primer
aaaggtacccgtgcatttgtaaacacgtagg

SEQ ID NO: 5263 - DNA, 30 bp, Artificial Sequence
  Primer
aaaggtacccgtgggaccctacatcaactc

SEQ ID NO: 5264 - DNA, 35 bp, Artificial Sequence
  Primer
aaaggtaccctaaaagctgcaccaagtaatgtgac

SEQ ID NO: 5265 - DNA, 30 bp, Artificial Sequence
  Primer
aaaggtaccctaaaaggtcaccagccatgc

SEQ ID NO: 5266 - DNA, 34 bp, Artificial Sequence
  Primer
aaaggtaccctaaacaaagcaaggcaatagtgtg

SEQ ID NO: 5267 - DNA, 33 bp, Artificial Sequence
  Primer
aaaggtaccctaaactaccctaccggacgggac

SEQ ID NO: 5268 - DNA, 36 bp, Artificial Sequence
  Primer
aaaggtaccctaaagcaaaacagatatgctgtagcc

SEQ ID NO: 5269 - DNA, 33 bp, Artificial Sequence
  Primer
aaaggtaccctaacgtagtctgcatgcactgtc

SEQ ID NO: 5270 - DNA, 34 bp, Artificial Sequence
  Primer
aaaggtaccctaagcggtcagacaatcttcactc

SEQ ID NO: 5271 - DNA, 35 bp, Artificial Sequence
  Primer
aaaggtaccctaatactgaacgtgcatgcaaaatg

SEQ ID NO: 5272 - DNA, 33 bp, Artificial Sequence
  Primer
aaaggtaccctaatcaaagacagcgcatgacac

SEQ ID NO: 5273 - DNA, 31 bp, Artificial Sequence
  Primer
aaaggtaccctaatccacaaggaaggcaaag

SEQ ID NO: 5274 - DNA, 34 bp, Artificial Sequence
  Primer
aaaggtaccctaatccgcagaaatcataggtttg

SEQ ID NO: 5275 - DNA, 34 bp, Artificial Sequence
  Primer
aaaggtaccctacaaagctaccaccagaagttcg

SEQ ID NO: 5276 - DNA, 39 bp, Artificial Sequence
  Primer
aaaggtaccctacacattggagtgactacacaaagtagg

SEQ ID NO: 5277 - DNA, 33 bp, Artificial Sequence
  Primer
aaaggtaccctacactgaccgactcgatctacc

SEQ ID NO: 5278 - DNA, 34 bp, Artificial Sequence
  Primer
aaaggtaccctacattgcattattgtggatgagc

SEQ ID NO: 5279 - DNA, 34 bp, Artificial Sequence
  Primer
aaaggtaccctactccaataacgacaaatcatcc

SEQ ID NO: 5280 - DNA, 34 bp, Artificial Sequence
  Primer
aaaggtaccctactgactggtgtactggacttgc

SEQ ID NO: 5281 - DNA, 28 bp, Artificial Sequence
  Primer
aaaggtaccctagctagcgctcgacacc

SEQ ID NO: 5282 - DNA, 31 bp, Artificial Sequence
  Primer
aaaggtaccctaggatgtcatctccgtgctg

SEQ ID NO: 5283 - DNA, 34 bp, Artificial Sequence
  Primer
aaaggtaccctagtacgtattggtgacgtggttc

SEQ ID NO: 5284 - DNA, 34 bp, Artificial Sequence
  Primer
aaaggtaccctatacgtacacacacacctgatgg

SEQ ID NO: 5285 - DNA, 35 bp, Artificial Sequence
  Primer
aaaggtaccctatagcaaacaccatccttgttctc

SEQ ID NO: 5286 - DNA, 33 bp, Artificial Sequence
  Primer
aaaggtaccctatatcaaccgccaagaacgtag

SEQ ID NO: 5287 - DNA, 34 bp, Artificial Sequence
  Primer
aaaggtaccctatccgggctgacataagataaag

SEQ ID NO: 5288 - DNA, 33 bp, Artificial Sequence
  Primer
aaaggtaccctatgaaccaattccactggtagc

SEQ ID NO: 5289 - DNA, 30 bp, Artificial Sequence
  Primer
aaaggtaccctatgacacgatcgcacacac

SEQ ID NO: 5290 - DNA, 33 bp, Artificial Sequence
  Primer
aaaggtaccctatgcatgcatgtacagacacag

SEQ ID NO: 5291 - DNA, 33 bp, Artificial Sequence
  Primer
aaaggtaccctattgctccgatccaacataaac

SEQ ID NO: 5292 - DNA, 34 bp, Artificial Sequence
  Primer
aaaggtaccctatttcataaatcgaagagccagc

SEQ ID NO: 5293 - DNA, 33 bp, Artificial Sequence
  Primer
aaaggtaccctatttggctgttagttcaggcag

SEQ ID NO: 5294 - DNA, 31 bp, Artificial Sequence
  Primer
aaaggtaccctcacaacaaatcagccaacag

SEQ ID NO: 5295 - DNA, 31 bp, Artificial Sequence
  Primer
aaaggtaccctccatgcaaatacacaggatg

SEQ ID NO: 5296 - DNA, 31 bp, Artificial Sequence
  Primer
aaaggtaccctctaccggcctgtaactgatg

SEQ ID NO: 5297 - DNA, 31 bp, Artificial Sequence
  Primer
aaaggtaccctctcgggttctcattctcaag

SEQ ID NO: 5298 - DNA, 31 bp, Artificial Sequence
  Primer
aaaggtaccctgcaagtgaggtctaacaagg

SEQ ID NO: 5299 - DNA, 31 bp, Artificial Sequence
  Primer
aaaggtacccttccatgttccatccaggtag

SEQ ID NO: 5300 - DNA, 32 bp, Artificial Sequence
  Primer
aaaggtaccctttctcagactctcaatgctgg

SEQ ID NO: 5301 - DNA, 31 bp, Artificial Sequence
  Primer
aaaggtaccgaacagcggaactggctatatg

SEQ ID NO: 5302 - DNA, 31 bp, Artificial Sequence
  Primer
aaaggtaccgacattaccctatctgccaagg

SEQ ID NO: 5303 - DNA, 31 bp, Artificial Sequence
  Primer
aaaggtaccgacggtgttaaccgatgttagg

SEQ ID NO: 5304 - DNA, 31 bp, Artificial Sequence
  Primer
aaaggtaccgagggcactaggaacaagacac

SEQ ID NO: 5305 - DNA, 33 bp, Artificial Sequence
  Primer
aaaggtaccgatcgtagaccggacttattatcg

SEQ ID NO: 5306 - DNA, 31 bp, Artificial Sequence
  Primer
aaaggtaccgatgccaccaaatcctaacttg

SEQ ID NO: 5307 - DNA, 30 bp, Artificial Sequence
  Primer
aaaggtaccgcaaatatgtcaggcacacag

SEQ ID NO: 5308 - DNA, 34 bp, Artificial Sequence
  Primer
aaaggtaccgcacaatttatggaacgcatattac

SEQ ID NO: 5309 - DNA, 32 bp, Artificial Sequence
  Primer
aaaggtaccgcagcacacgtactctactctgg

SEQ ID NO: 5310 - DNA, 31 bp, Artificial Sequence
  Primer
aaaggtaccgccagctaacagattgtgttcc

SEQ ID NO: 5311 - DNA, 33 bp, Artificial Sequence
  Primer
aaaggtaccgcccaaatcgaagtataatttctg

SEQ ID NO: 5312 - DNA, 31 bp, Artificial Sequence
  Primer
aaaggtaccgcctaatggttcacatcaacac

SEQ ID NO: 5313 - DNA, 31 bp, Artificial Sequence
  Primer
aaaggtaccgcgacctgtagctgtagagagg

SEQ ID NO: 5314 - DNA, 27 bp, Artificial Sequence
  Primer
aaaggtaccgcggatgagacgtcagtg

SEQ ID NO: 5315 - DNA, 31 bp, Artificial Sequence
  Primer
aaaggtaccgctatgatggcaagatggacac

SEQ ID NO: 5316 - DNA, 31 bp, Artificial Sequence
  Primer
aaaggtaccgctcttacattgtgatcccgag

SEQ ID NO: 5317 - DNA, 31 bp, Artificial Sequence
  Primer
aaaggtaccgctctttggcattagctctcac

SEQ ID NO: 5318 - DNA, 31 bp, Artificial Sequence
  Primer
aaaggtaccgctgtataaagggacatcctcg

SEQ ID NO: 5319 - DNA, 31 bp, Artificial Sequence
  Primer
aaaggtaccggaatgaacattcaccttggag

SEQ ID NO: 5320 - DNA, 31 bp, Artificial Sequence
  Primer
aaaggtaccgggcagaatgctattgtacagc

SEQ ID NO: 5321 - DNA, 31 bp, Artificial Sequence
  Primer
aaaggtaccggtacaaattggagcaaacacg

SEQ ID NO: 5322 - DNA, 31 bp, Artificial Sequence
  Primer
aaaggtaccggtcaaacgtgcttctcatttc

SEQ ID NO: 5323 - DNA, 31 bp, Artificial Sequence
  Primer
aaaggtaccgtacaagccgaaatgatcaacc

SEQ ID NO: 5324 - DNA, 31 bp, Artificial Sequence
  Primer
aaaggtaccgtactacacgtgcggacatcac

SEQ ID NO: 5325 - DNA, 31 bp, Artificial Sequence
  Primer
aaaggtaccgtcactagcaaacgtgctttcc

SEQ ID NO: 5326 - DNA, 31 bp, Artificial Sequence
  Primer
aaaggtaccgttggtggcagatacaacactc

SEQ ID NO: 5327 - DNA, 31 bp, Artificial Sequence
  Primer
aaaggtaccgtttcaatgggacacacatgac

SEQ ID NO: 5328 - DNA, 32 bp, Artificial Sequence
  Primer
aaaggtaccgtttctgaatacaggcctcaagc

SEQ ID NO: 5329 - DNA, 31 bp, Artificial Sequence
  Primer
aaaggtacctaacatatcgcaggaacagcac

SEQ ID NO: 5330 - DNA, 31 bp, Artificial Sequence
  Primer
aaaggtacctaactaactgttgcccgtcagc

SEQ ID NO: 5331 - DNA, 31 bp, Artificial Sequence
  Primer
aaaggtacctacctattgaagcaccaggcac

SEQ ID NO: 5332 - DNA, 31 bp, Artificial Sequence
  Primer
aaaggtacctagcattcagtaactccgggtc

SEQ ID NO: 5333 - DNA, 31 bp, Artificial Sequence
  Primer
aaaggtacctaggactggcttccgtatgaac

SEQ ID NO: 5334 - DNA, 31 bp, Artificial Sequence
  Primer
aaaggtacctagttcctatcagcggaacctc

SEQ ID NO: 5335 - DNA, 31 bp, Artificial Sequence
  Primer
aaaggtacctattacaggtgtccctcggttg

SEQ ID NO: 5336 - DNA, 31 bp, Artificial Sequence
  Primer
aaaggtacctattagcttgaagcagcacacg

SEQ ID NO: 5337 - DNA, 31 bp, Artificial Sequence
  Primer
aaaggtacctcaaatacagggagaaccgaag

SEQ ID NO: 5338 - DNA, 31 bp, Artificial Sequence
  Primer
aaaggtacctcagtcaccaaaccaagcatag

SEQ ID NO: 5339 - DNA, 31 bp, Artificial Sequence
  Primer
aaaggtacctcatagaagctcgaactccctc

SEQ ID NO: 5340 - DNA, 31 bp, Artificial Sequence
  Primer
aaaggtacctcatatcatcagcaacatgacg

SEQ ID NO: 5341 - DNA, 31 bp, Artificial Sequence
  Primer
aaaggtacctccatcaaatccctaggaacag

SEQ ID NO: 5342 - DNA, 31 bp, Artificial Sequence
  Primer
aaaggtacctcccaccattcagtttcaattc

SEQ ID NO: 5343 - DNA, 31 bp, Artificial Sequence
  Primer
aaaggtacctcctccacaattagctttgacc

SEQ ID NO: 5344 - DNA, 31 bp, Artificial Sequence
  Primer
aaaggtacctcgatgcaacataaatctctcg

SEQ ID NO: 5345 - DNA, 31 bp, Artificial Sequence
  Primer
aaaggtacctcgctatggtgcaaactaacac

SEQ ID NO: 5346 - DNA, 33 bp, Artificial Sequence
  Primer
aaaggtacctcttctgctatgctagacagtggg

SEQ ID NO: 5347 - DNA, 31 bp, Artificial Sequence
  Primer
aaaggtacctgacagcacataggagaactgg

SEQ ID NO: 5348 - DNA, 31 bp, Artificial Sequence
  Primer
aaaggtacctgacattcttcaccaccatgag

SEQ ID NO: 5349 - DNA, 31 bp, Artificial Sequence
  Primer
aaaggtacctgatatctggaccaactcatgc

SEQ ID NO: 5350 - DNA, 31 bp, Artificial Sequence
  Primer
aaaggtacctgatcatcgccatacatgaaac

SEQ ID NO: 5351 - DNA, 32 bp, Artificial Sequence
  Primer
aaaggtacctgcaaacaagtatcgaaatcctc

SEQ ID NO: 5352 - DNA, 31 bp, Artificial Sequence
  Primer
aaaggtacctgcatcaaccaatagtccaatg

SEQ ID NO: 5353 - DNA, 31 bp, Artificial Sequence
  Primer
aaaggtacctgccctttacaaacgttctctg

SEQ ID NO: 5354 - DNA, 31 bp, Artificial Sequence
  Primer
aaaggtacctgcgatcatcagaatctaccac

SEQ ID NO: 5355 - DNA, 31 bp, Artificial Sequence
  Primer
aaaggtacctgctgatcttaagtcccaatcc

SEQ ID NO: 5356 - DNA, 31 bp, Artificial Sequence
  Primer
aaaggtacctggagctgacaaacacaaactc

SEQ ID NO: 5357 - DNA, 34 bp, Artificial Sequence
  Primer
aaaggtacctgtccgtatttactggtgtacagtg

SEQ ID NO: 5358 - DNA, 31 bp, Artificial Sequence
  Primer
aaaggtacctgtgcttgtgctaattgaaagg

SEQ ID NO: 5359 - DNA, 31 bp, Artificial Sequence
  Primer
aaaggtacctgtggtagcatgagctttgaac

SEQ ID NO: 5360 - DNA, 30 bp, Artificial Sequence
  Primer
aaaggtaccttaaccggatccgcttcagaa

SEQ ID NO: 5361 - DNA, 31 bp, Artificial Sequence
  Primer
aaaggtaccttcagacagatcactcgtctcg

SEQ ID NO: 5362 - DNA, 31 bp, Artificial Sequence
  Primer
aaaggtaccttcagatatgctctgttcgtcg

SEQ ID NO: 5363 - DNA, 31 bp, Artificial Sequence
  Primer
aaaggtaccttcctagacgagggacagattc

SEQ ID NO: 5364 - DNA, 31 bp, Artificial Sequence
  Primer
aaaggtaccttcgtttacgtcgtttctctcc

SEQ ID NO: 5365 - DNA, 31 bp, Artificial Sequence
  Primer
aaaggtaccttggctagtttcctagtgcctg

SEQ ID NO: 5366 - DNA, 31 bp, Artificial Sequence
  Primer
aaaggtaccttggtcagtgaagacaccagtc

SEQ ID NO: 5367 - DNA, 32 bp, Artificial Sequence
  Primer
aaaggtaccttgtcaaaactccagtatgttgc

SEQ ID NO: 5368 - DNA, 34 bp, Artificial Sequence
  Primer
aaagtcgacaaagaagacgataacaactagcacg

SEQ ID NO: 5369 - DNA, 31 bp, Artificial Sequence
  Primer
aaagtcgacaaagacttgcatccaaccaatc

SEQ ID NO: 5370 - DNA, 28 bp, Artificial Sequence
  Primer
aaagtcgacaacactgcaccagctccac

SEQ ID NO: 5371 - DNA, 31 bp, Artificial Sequence
  Primer
aaagtcgacaataccgaggctcagttgtttg

SEQ ID NO: 5372 - DNA, 31 bp, Artificial Sequence
  Primer
aaagtcgacaatcccaccacttgtgtctacc

SEQ ID NO: 5373 - DNA, 29 bp, Artificial Sequence
  Primer
aaagtcgacacacacaggccaatcaatcc

SEQ ID NO: 5374 - DNA, 30 bp, Artificial Sequence
  Primer
aaagtcgacactactagctgccgtaccgtg

SEQ ID NO: 5375 - DNA, 34 bp, Artificial Sequence
  Primer
aaagtcgacactagagtctcaactcttgagcagg

SEQ ID NO: 5376 - DNA, 29 bp, Artificial Sequence
  Primer
aaagtcgacacttcccaccaacaaaccac

SEQ ID NO: 5377 - DNA, 30 bp, Artificial Sequence
  Primer
aaagtcgacagaaacatgcgagacatggag

SEQ ID NO: 5378 - DNA, 29 bp, Artificial Sequence
  Primer
aaagtcgacagagctagcgcaagaaatgg

SEQ ID NO: 5379 - DNA, 28 bp, Artificial Sequence
  Primer
aaagtcgacagcacgcccttctttgttc

SEQ ID NO: 5380 - DNA, 31 bp, Artificial Sequence
  Primer
aaagtcgacagcagctcaaaactttagccag

SEQ ID NO: 5381 - DNA, 30 bp, Artificial Sequence
  Primer
aaagtcgacagcaggcatatagatcggtcc

SEQ ID NO: 5382 - DNA, 31 bp, Artificial Sequence
  Primer
aaagtcgacagctaccaacctctccctcttc

SEQ ID NO: 5383 - DNA, 28 bp, Artificial Sequence
  Primer
aaagtcgacagctctttgccgcgtttac

SEQ ID NO: 5384 - DNA, 31 bp, Artificial Sequence
  Primer
aaagtcgacagtctagcatcaggcatccatc

SEQ ID NO: 5385 - DNA, 31 bp, Artificial Sequence
  Primer
aaagtcgacatctactaccgacgcacctctc

SEQ ID NO: 5386 - DNA, 28 bp, Artificial Sequence
  Primer
aaagtcgacatgccacgctacgaggttc

SEQ ID NO: 5387 - DNA, 31 bp, Artificial Sequence
  Primer
aaagtcgacatttctcttaggctcacccgtc

SEQ ID NO: 5388 - DNA, 31 bp, Artificial Sequence
  Primer
aaagtcgacatttgcgtagtagcgttggttc

SEQ ID NO: 5389 - DNA, 27 bp, Artificial Sequence
  Primer
aaagtcgaccaacccaaccacgaggac

SEQ ID NO: 5390 - DNA, 33 bp, Artificial Sequence
  Primer
aaagtcgaccaagtaagtaagcacactcgaacg

SEQ ID NO: 5391 - DNA, 32 bp, Artificial Sequence
  Primer
aaagtcgaccatctgctgcatagaggagtttc

SEQ ID NO: 5392 - DNA, 31 bp, Artificial Sequence
  Primer
aaagtcgaccccgttctacttagctagcgtc

SEQ ID NO: 5393 - DNA, 32 bp, Artificial Sequence
  Primer
aaagtcgaccctcctctgtcctcgtataaagc

SEQ ID NO: 5394 - DNA, 31 bp, Artificial Sequence
  Primer
aaagtcgaccctgtctgtctgtctccagagc

SEQ ID NO: 5395 - DNA, 31 bp, Artificial Sequence
  Primer
aaagtcgaccctgtgtttgtgcttgtctcag

SEQ ID NO: 5396 - DNA, 31 bp, Artificial Sequence
  Primer
aaagtcgacccttctcgtggatctgaatgag

SEQ ID NO: 5397 - DNA, 31 bp, Artificial Sequence
  Primer
aaagtcgacccttctgcgctcagtattcaac

SEQ ID NO: 5398 - DNA, 28 bp, Artificial Sequence
  Primer
aaagtcgaccgaagactcctccgaatcc

SEQ ID NO: 5399 - DNA, 31 bp, Artificial Sequence
  Primer
aaagtcgaccgcctcggataactactagctg

SEQ ID NO: 5400 - DNA, 30 bp, Artificial Sequence
  Primer
aaagtcgacctagccctaaacctcgctgac

SEQ ID NO: 5401 - DNA, 27 bp, Artificial Sequence
  Primer
aaagtcgacctccacttcgccacttcc

SEQ ID NO: 5402 - DNA, 32 bp, Artificial Sequence
  Primer
aaagtcgaccttagctagcgtcagccttcttc

SEQ ID NO: 5403 - DNA, 29 bp, Artificial Sequence
  Primer
aaagtcgaccttgctaagggaagggaagg

SEQ ID NO: 5404 - DNA, 31 bp, Artificial Sequence
  Primer
aaagtcgacctttcacaaagctgtctccgtc

SEQ ID NO: 5405 - DNA, 31 bp, Artificial Sequence
  Primer
aaagtcgacgagacgcacgtaggagtagagc

SEQ ID NO: 5406 - DNA, 36 bp, Artificial Sequence
  Primer
aaagtcgacgagggtacagaaaagagagagaagatg

SEQ ID NO: 5407 - DNA, 31 bp, Artificial Sequence
  Primer
aaagtcgacgatcccaacagaggaatcacac

SEQ ID NO: 5408 - DNA, 31 bp, Artificial Sequence
  Primer
aaagtcgacgattagcctctctgtcatgtcg

SEQ ID NO: 5409 - DNA, 29 bp, Artificial Sequence
  Primer
aaagtcgacgattcgcgtttggaactttg

SEQ ID NO: 5410 - DNA, 31 bp, Artificial Sequence
  Primer
aaagtcgacgcctctctttgtcactaccgtc

SEQ ID NO: 5411 - DNA, 27 bp, Artificial Sequence
  Primer
aaagtcgacgcctggtccaatgcaact

SEQ ID NO: 5412 - DNA, 28 bp, Artificial Sequence
  Primer
aaagtcgacgctagggtttcgatccgtg

SEQ ID NO: 5413 - DNA, 30 bp, Artificial Sequence
  Primer
aaagtcgacggaaacgagagatccttggag

SEQ ID NO: 5414 - DNA, 28 bp, Artificial Sequence
  Primer
aaagtcgacggagacttggtggatgctg

SEQ ID NO: 5415 - DNA, 31 bp, Artificial Sequence
  Primer
aaagtcgacggattagttgagcagaaggcag

SEQ ID NO: 5416 - DNA, 30 bp, Artificial Sequence
  Primer
aaagtcgacgggatcaatcaagccaaagag

SEQ ID NO: 5417 - DNA, 31 bp, Artificial Sequence
  Primer
aaagtcgacgtctctgtccacagattcctcc

SEQ ID NO: 5418 - DNA, 31 bp, Artificial Sequence
  Primer
aaagtcgacgtgcgctttctctagtctgtgc

SEQ ID NO: 5419 - DNA, 31 bp, Artificial Sequence
  Primer
aaagtcgacgttcaacctgggtttgagtttg

SEQ ID NO: 5420 - DNA, 31 bp, Artificial Sequence
  Primer
aaagtcgacgttcgggattagcctctctgtc

SEQ ID NO: 5421 - DNA, 30 bp, Artificial Sequence
  Primer
aaagtcgactaacaactagcacgggagcag

SEQ ID NO: 5422 - DNA, 30 bp, Artificial Sequence
  Primer
aaagtcgactactctgagcgggtaccgtag

SEQ ID NO: 5423 - DNA, 31 bp, Artificial Sequence
  Primer
aaagtcgactaggaaggcaagaaacgttgtg

SEQ ID NO: 5424 - DNA, 31 bp, Artificial Sequence
  Primer
aaagtcgactcaactagattcggagcaatcc

SEQ ID NO: 5425 - DNA, 26 bp, Artificial Sequence
  Primer
aaagtcgactccggttcacgccgcct

SEQ ID NO: 5426 - DNA, 33 bp, Artificial Sequence
  Primer
aaagtcgactctctcttctattccattcccaac

SEQ ID NO: 5427 - DNA, 28 bp, Artificial Sequence
  Primer
aaagtcgactctgttaaacacgcgcagc

SEQ ID NO: 5428 - DNA, 31 bp, Artificial Sequence
  Primer
aaagtcgactcttccttgtcgattccatttc

SEQ ID NO: 5429 - DNA, 35 bp, Artificial Sequence
  Primer
aaagtcgactgactagtcactagcactagctgggg

SEQ ID NO: 5430 - DNA, 31 bp, Artificial Sequence
  Primer
aaagtcgactgcttccttacttgcttcatcc

SEQ ID NO: 5431 - DNA, 32 bp, Artificial Sequence
  Primer
aaagtcgactgtctcagtgacgtgaactcatc

SEQ ID NO: 5432 - DNA, 31 bp, Artificial Sequence
  Primer
aaagtcgacttgtgggtagaggactagggac

SEQ ID NO: 5433 - DNA, 28 bp, Artificial Sequence
  Primer
aaagtcgacttgttcctccgactcccac

SEQ ID NO: 5434 - DNA, 29 bp, Artificial Sequence
  Primer
aaagtcgactttgctgcagagagctcaag

SEQ ID NO: 5435 - DNA, 32 bp, Artificial Sequence
  Primer
tttggtaccttaataatcgcgaattcagagcc

SEQ ID NO: 5436 - DNA, 555 bp, Streptomyces hygroscopicus (A10) Bar Gene
atgagcccagaacgacgcccggccgacatccgccgtgccaccgaggcggacatgccggcggtctgcaccatcgtcaaccactacatcgagacaagcacggtcaacttccgtaccgagccgcaggaaccgcaggagtggacggacgacctcgtccgtctgcgggagcgctatccctggctcgtcgccgaggtggacggcgaggtcgccggcatcgcctacgcgggcccctggaaggcacgcaacgcctacgactggacggccgagtcgaccgtgtacgtctccccccgccaccagcggacgggactgggctccacgctctacacccacctgctgaagtccctggaggcacagggcttcaagagcgtggtcgctgtcatcgggctgcccaacgacccgagcgtgcgcatgcacgaggcgctcggatatgccccccgcggcatgctgcgggcggccggcttcaagcacgggaactggcatgacgtgggtttctggcagctggacttcagcctgccggtaccgccccgtccggtcctgcccgtcaccgagatctgatga
